(12) United States Patent  
Puzio et al.

(10) Patent No.: US 8,664,475 B2  
(45) Date of Patent: Mar. 4, 2014

(54) PLANTS WITH INCREASED YIELD

(75) Inventors: Piotr Puzio, Mariakerke (BE); Oliver Bläsing, Potsdam (DE); Oliver Thimm, Berlin (DE); Gerhard Ritte, Potzdam (DE); Hardy Schön, Berlin (DE)

(73) Assignee: BASF Plant Science GmbH, Ludwigshafen (DE)

( * ) Notice: Subject to any disclaimer, the term of this patent is extended or adjusted under 35 U.S.C. 154(b) by 451 days.

(21) Appl. No.: 12/678,387

(22) PCT Filed: Sep. 17, 2008

(86) PCT No.: PCT/EP2008/062362  
§ 371 (c)(1),  
(2), (4) Date: Mar. 16, 2010

(87) PCT Pub. No.: WO2009/037279  
PCT Pub. Date: Mar. 26, 2009

(65) Prior Publication Data  
US 2011/0277179 A1    Nov. 10, 2011

(30) Foreign Application Priority Data

Sep. 18, 2007  (EP) .................................... 07117448  
Jul. 25, 2008  (EP) .................................... 08161134

(51) Int. Cl.  
  *C12N 15/82*  (2006.01)  
  *C12N 15/63*  (2006.01)

(52) U.S. Cl.  
  USPC ............................................. 800/278; 435/468

(58) Field of Classification Search  
  None  
  See application file for complete search history.

(56) References Cited

U.S. PATENT DOCUMENTS

| | | | |
|---|---|---|---|
| 6,620,610 B2 | 9/2003 | Frommer et al. | |
| 2001/0003848 A1 | 6/2001 | Frommer et al. | |
| 2003/0204867 A1 | 10/2003 | Frommer et al. | |
| 2003/0233675 A1* | 12/2003 | Cao et al. ..................... | 800/279 |
| 2005/0097640 A1 | 5/2005 | Fernandes | |
| 2005/0108791 A1 | 5/2005 | Edgerton | |
| 2006/0037108 A1 | 2/2006 | McCourt et al. | |
| 2007/0118916 A1* | 5/2007 | Puzio et al. .................. | 800/278 |
| 2009/0089899 A1 | 4/2009 | Shinozaki et al. | |
| 2009/0300794 A1 | 12/2009 | Plesch et al. | |
| 2010/0031380 A1 | 2/2010 | Kamlage et al. | |
| 2010/0162432 A1 | 6/2010 | Puzio et al. | |
| 2010/0170003 A1 | 7/2010 | Shirley et al. | |
| 2010/0205690 A1 | 8/2010 | Bläsing et al. | |
| 2010/0251416 A1 | 9/2010 | Puzio et al. | |
| 2010/0293665 A1 | 11/2010 | Puzio et al. | |
| 2010/0333234 A1 | 12/2010 | Shirley et al. | |
| 2011/0010800 A1 | 1/2011 | Ritte et al. | |
| 2011/0035841 A1 | 2/2011 | Plesch et al. | |
| 2011/0098183 A1 | 4/2011 | Bläsing et al. | |
| 2011/0107457 A1 | 5/2011 | Frank et al. | |
| 2011/0154530 A1 | 6/2011 | Bläsing et al. | |
| 2011/0258736 A1 | 10/2011 | Puzio et al. | |
| 2011/0277179 A1 | 11/2011 | Puzio et al. | |

FOREIGN PATENT DOCUMENTS

| | | |
|---|---|---|
| CA | 2007091 A1 | 6/1990 |
| DE | 43 37 597 A1 | 5/1995 |
| EP | 0 375 091 A1 | 6/1990 |
| EP | 1 616 940 A1 | 1/2006 |
| EP | 1 914 308 A1 | 4/2008 |
| WO | WO-92/13082 A1 | 8/1992 |
| WO | WO-95/09911 A1 | 4/1995 |
| WO | WO 00/05386 * | 2/2000 |
| WO | WO-00/05386 A2 | 2/2000 |
| WO | WO 0155433 A2 * | 8/2001 |
| WO | WO 2006/021558 * | 3/2006 |
| WO | WO-2006/021558 A2 | 3/2006 |
| WO | WO-2006/032708 A2 | 3/2006 |
| WO | WO-2006/137574 A1 | 12/2006 |
| WO | WO-2007/044988 A2 | 4/2007 |
| WO | WO-2007/052376 A1 | 5/2007 |
| WO | WO-2007/078280 A2 | 7/2007 |

OTHER PUBLICATIONS

Plant Physiol., 108:1413-1421, 1995.*  
Wells, Biochemistry 29:8509-8517, 1990.*  
Ngo et al., (The Protein Folding Problem and Tertiary Structure Prediction, K. Merz., and S. Le Grand (eds.) pp. 492-495,1994).*  
Guo et al. (PNAS, 101: 9205-9210, 2004).*  
Keskin et al. (Protein Science, 13:1043-1055, 2004).*  
Thornton et al. (Nature structural Biology, structural genomics supplement, Nov. 2000).*  
Maniatis et al. (Molecular Cloning: A Laboratory Manual, Cold Spring Harbor Laboratory, 1982).*  
Zhou et al. (Bioorganic Chemistry, 40:79-86, 2012).*  
Ma et al. (Protein Expression and Purification, 82:263-269, 2012).*  
Doerks et al., (TIG, 14:248-250, 1998).*  
Smith et al. (Nature Biotechnology, 15:1222-1223, 1997).*  
Bork et al. (TIG, 12:425-427, 1996).*  
Jones, J. D., et al., "Impaired Wound Induction of 3-Deoxy-D-arabino-heptulosonate-7-phosphate (DAHP) Synthase and Altered Stem Development in Transgenic Potato Plants Expressing a DAHP Synthase Antisense Construct", Plant Physiol., 1995, vol. 108, No. 4, pp. 1413-1421.  
Good, A. G., et al. "Can Less Yield More? Is Reducing Nutrient Input into the Environment Compatible with Maintaining Crop Production?", Trends Plant Sci., 2004, vol. 9, No. 12, pp. 597-605.  
Miflin, B. J., et al., "The Role of Glutamine Synthetase and Glutamate Dehydrogenase in Nitrogen Assimilation and Possibilities for Improvement in the Nitrogen Utilization of Crops", J. Exp. Bot., 2002, vol. 53, No. 370, pp. 979-987.  
Van Camp, W., "Yield Enhancement Genes: Seeds for Growth", Curr Opin Biotechnol., 2005, vol. 16, No. 2, pp. 147-153.

(Continued)

*Primary Examiner* — Vinod Kumar  
(74) *Attorney, Agent, or Firm* — Novak Druce Connolly Bove + Quigg LLP

(57) ABSTRACT

This invention relates generally to a plant cell with enhanced nitrogen use efficiency and/or increased biomass production as compared to a corresponding non-transformed wild type plant cell by increasing or generating one or more activities of polypeptides associated with enhanced nitrogen use efficiency in plants.

7 Claims, 6 Drawing Sheets

(56) References Cited

OTHER PUBLICATIONS

Guillet, G., et al., "Expression of Tryptophan Decarboxylase and Tyrosine Decarboxylase Genes in Tobacco Results in Altered Biochemical and Physiological Phenotypes", Plant Physiol., 2000, vol. 122, No. 3, pp. 933-943.
Andaya, V. C., et al., "Fine Mapping of the qCTS12 Locus, a Major QTL for Seedling Cold Tolerance in Rice", Theor. Appl. Genet., 2006, vol. 113, pp. 467-475.
Singh, B. K., et al., "Molecular Regulation of Amino Acid Biosynthesis in Plants", Amino Acids, 1994, vol. 7, pp. 165-174.
"RecName: Full=Phospho-2-Dehydro-3-Deoxyheptonate Aldolase; EC=2.5.1.54", Database UniProt Accession No. Q32IH1, Dec. 6, 2005.
Görlach, J., et al., "Differential Expression of Tomato (Lycopersicon esculentum L.) Genes Encoding Shikimate Pathway Isoenzymes. I. 3-Deoxy-D-Arabino-Heptulosonate 7-Phosphate Synthase", Plant Molecular Biology, 1993, vol. 23, pp. 697-706.
Görlach, J., et al., "Abundance of Transcripts Specific for Genes Encoding Enzymes of the Prechorismate Pathway in Different Organs of Tomato (Lycopersicon esculentum L.) Plants", Planta, 1994, vol. 193, pp. 216-223.
Ahn, J. H., et al., "A Novel Extensin Gene Encoding a Hydroxyproline-Rich Glycoprotein Requires Sucrose for Its Wound-Inducible Expression in Transgenic Plants", The Plant Cell, 1996, vol. 8, pp. 1477-1490.
Altschul, S. F., et al., "Gapped BLAST and PSI-BLAST: A New Generation of Protein Database Search Programs", Nucleic Acids Research, 1997, vol. 25, No. 17, pp. 3389-3402.
Amann, E., et al., "Tightly Regulated tac Promoter Vectors Useful for the Expression of Unfused and Fused Proteins in Escherichia coli", Gene, 1988, vol. 69, pp. 301-315.
An, G., "Binary Ti Plasmid Vectors", Methods in Molecular Biology, vol. 44: Agrobacterium Protocols, pp. 47-58., 1995.
"Using DNA Fragments as Probes", Unit 6.3 in Current Protocols in Molecular Biology, Ausuble, F. M., et al., eds., 1993, pp. 6.3.1-6.3.6, John Wiley & Sons.
Babic, V., et al., "Development of an Efficient Agrobacterium-mediated Transformation Systems for Brassica carinata", Plant Cell Reports, 1998, vol. 17, pp. 183-188.
Bäumlein, H., et al., "Cis-Analysis of a Seed Protein Gene Promoter: The Conservative RY Repeat CATGCATG within the Legumin Box is Essential for Tissue-Specific Expression of a Legumin Gene", The Plant Journal, 1992, vol. 2, No. 2, pp. 233-239.
Baker, S. S., et al., "The 5'-Region of Arabidopsis thaliana corl5a Has cis-Acting Elements that Confer Cold-, Drought- and ABA-Regulated Gene Expression", Plant Molecular Biology, 1994, vol. 24, pp. 701-713.
Bartel, D. P., et al., "Isolation of New Ribozymes from a Large Pool of Random Sequences", Science, 1993, vol. 261, pp. 1411-1418.
Bebbington, C. R., et al., "High-Level Expression of a Recombinant Antibody from Myeloma Cells Using a Glutamine Synthetase Gene as an Amplifiable Selectable Marker", Bio/Technology, 1992, vol. 10, pp. 169-175.
Becker, D., et al., "New Plant Binary Vectors with Selectable Markers Located Proximal to the Left T-DNA Border", Plant Molecular Biology, 1992, vol. 20, pp. 1195-1197.
Benfey, P. N., et al., "The CaMV 35S Enhancer Contains at Least Two Domains Which can Confer Different Developmental and Tissue-Specific Expression Patterns", The EMBO Journal, 1989, vol. 8, No. 8, pp. 2195-2202.

Bevan, M., "Binary Agrobacterium Vectors for Plant Transformation", Nucleic Acids Research, 1984, vol. 12, No. 22, pp. 8711-8721.
Blattner, F. R., et al., "The Complete Genome Sequence of Escherichia coli K-12", Science, 1997, vol. 277, pp. 1453-1462.
Bloom, A. J., et al., "Root Respiration Associated with Ammonium and Nitrate Absorption and Assimilation by Barley", Plant Physiol., 1992, vol. 99, pp. 1294-1301.
Bohnert, H. J., et al., "Adaptations to Environmental Stresses", The Plant Cell, 1995, vol. 7, pp. 1099-1111.
Boyer, J. S., "Plant Productivity and Environment", Science, 1982, vol. 218, pp. 443-448.
Chichkova, S., et al., "Transgenic Tobacco Plants that Overexpress Alfalfa NADH-Glutamate Synthase Have Higher Carbon and Nitrogen Content", Journal of Experimental Botany, 2001, vol. 52, No. 364, pp. 2079-2087.
Cook, D., et al., "A Prominent Role for the CBF Cold Response Pathway in Configuring the Low-Temperature Metabolome of Arabidopsis", PNAS, 2004, vol. 101, No. 42, pp. 15243-15248.
Crawford, N. M., et al., "Molecular and Physiological Aspects of Nitrate Uptake in Plants", Trends in Plant Science, 1998, vol. 3, No. 10, pp. 389-395.
Goffeau, A., et al., "Life with 6000 Genes", Science, 1996, vol. 274, pp. 546, 563-567.
Hirsch, R. E., et al., "Improving Nutrient Capture from Soil by the Genetic Manipulation of Crop Plants", Trends in Biotechnol., 1999, vol. 17, pp. 356-361.
Lam, H.-M., et al., "Overexpression of the ASN1 Gene Enhances Nitrogen Status in Seeds of Arabidopsis", Plant Physiology, 2003, vol. 132, pp. 926-935.
Smirnoff, N., "Plant Resistance to Environmental Stress", Current Opinion in Biotechnology, 1998, vol. 9, pp. 214-219.
Von Wirén, N., et al., "The Molecular Physiology of Ammonium Uptake and Retrieval", Current Opinion in Plant Biology, 2000, vol. 3, pp. 254-261.
Wang, W., et al., "Plant Responses to Drought, Salinity and Extreme Temperatures: Towards Genetic Engineering for Stress Tolerance", Planta, 2003, vol. 218, pp. 1-14.
Yanagisawa, S., et al., "Metabolic Engineering with Dof1 Transcription Factor in Plants: Improved Nitrogen Assimilation and Growth Under Low-Nitrogen Conditions", PNAS, 2004, vol. 101, No. 20, pp. 7833-7838.
Zhu, J.-K., "Cell Signaling under Salt, Water and Cold Stresses", Current Opinion in Plant Biology, 2001, vol. 4, pp. 401-406.
Zhu, J.-K., "Plant Salt Tolerance", Trends in Plant Science, 2001, vol. 6, No. 2, pp. 66-71.
Knight, H., et al., "Abiotic Stress Signalling Pathways: Specificity and Cross-Talk", Trends in Plant Science, 2001, vol. 6, No. 6, pp. 262-267.
Serrano, R., et al., "Genetic Engineering of Salt and Drought Tolerance with Yeast Regulatory Genes", Scientia Horticulturae, 1999, vol. 78, pp. 261-269.
Serrano, R., et al., "A Glimpse of the Mechanisms of Ion Homeostasis during Salt Stress", Journal of Experimental Botany, 1999, vol. 50, Special Issue, pp. 1023-1036.
Shinozaki, K., et al., "Molecular Responses to Dehydration and Low Temperature: Differences and Cross-Talk between Two Stress Signaling Pathways", Current Opinion in Plant Biology, 2000, vol. 3, pp. 217-223.

\* cited by examiner

Fig. 1a Vector VC-MME220-1 SEQ ID NO: 1 used for cloning gene of interest for non-targeted expression.
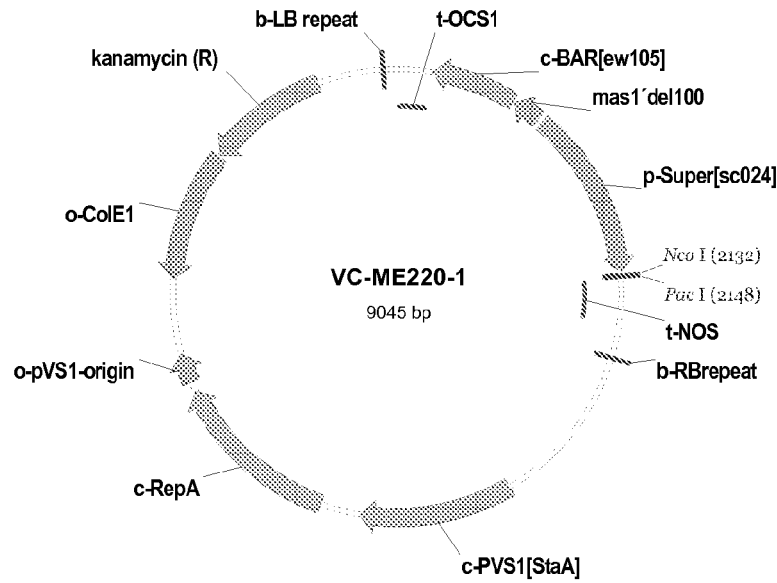
Fig. 1b Vector VC-MME220-1qcz SEQ ID NO: 14389 used for cloning gene of interest for non-targeted expression.
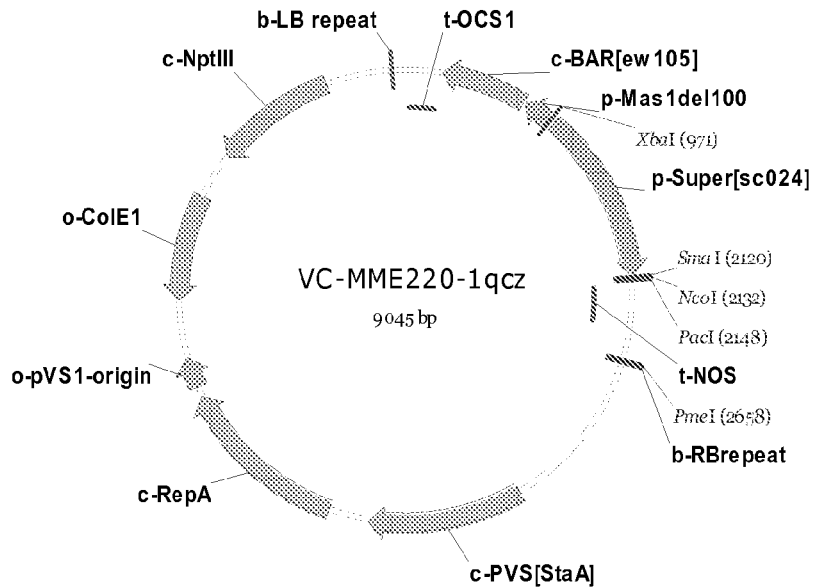

Fig. 2a Vector VC-MME221-1 SEQ ID NO: 2 used for cloning gene of interest for non-targeted expression.
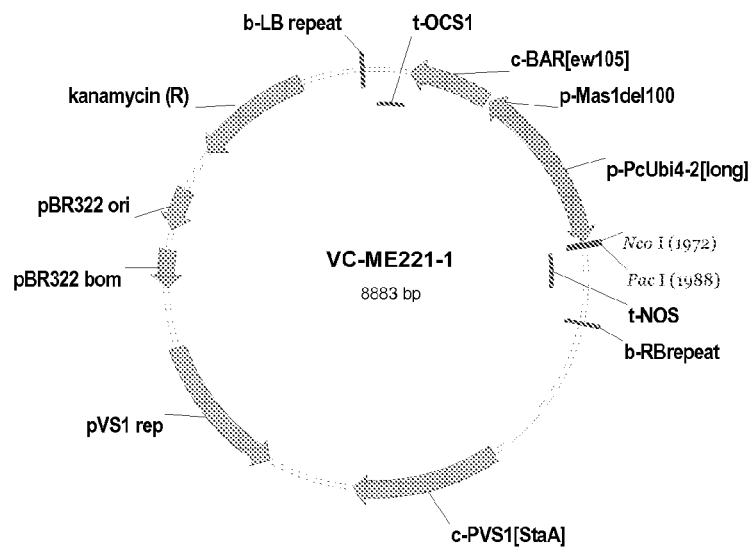
Fig. 2b Vector VC-MME221-1qcz (SEQ ID NO: 14390) used for cloning gene of interest for non-targeted expression.
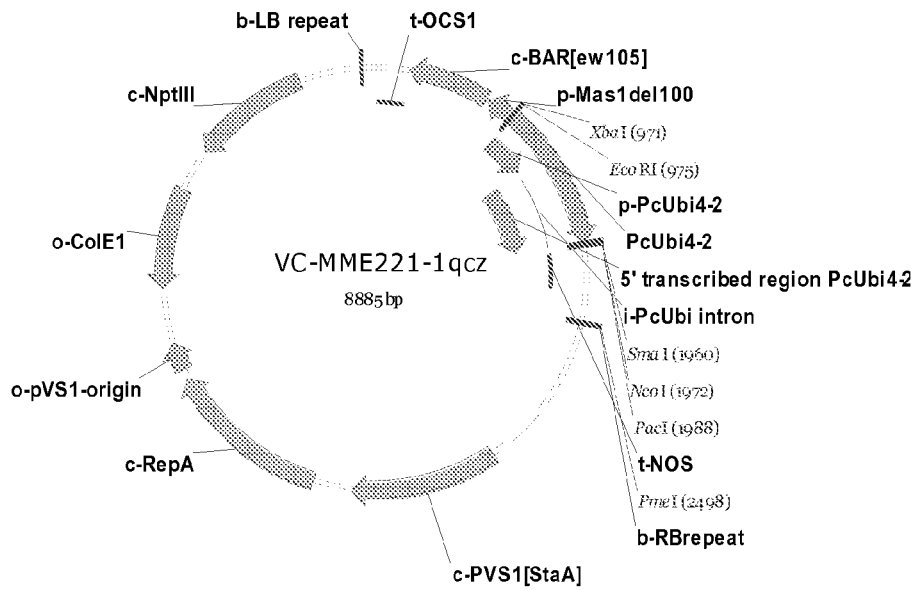

Fig. 3a Vector VC-MME354-1 SEQ ID NO: 3 used for cloning gene of interest for targeted expression.
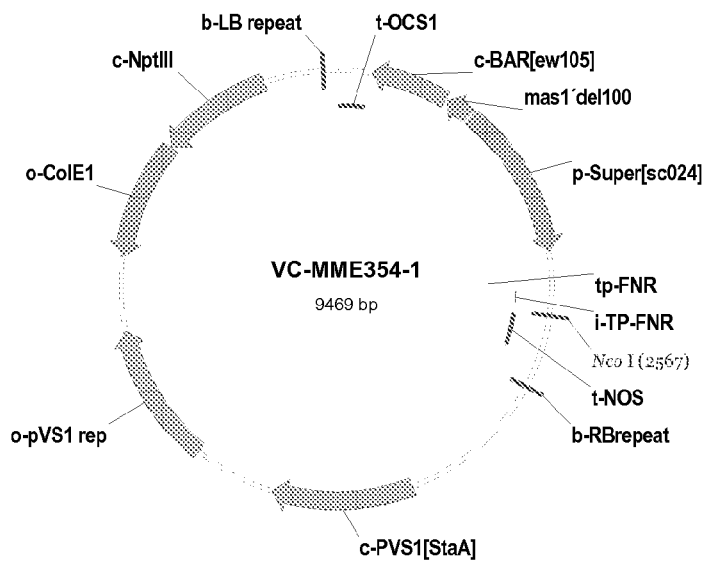
Fig. 3b Vector VC-MME354-1QCZ SEQ ID NO: 14391 used for cloning gene of interest for targeted expression.
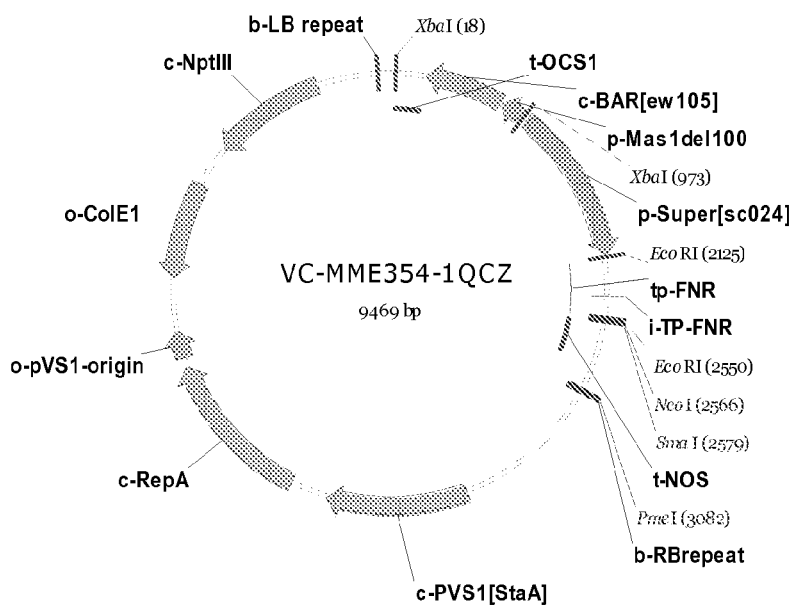

Fig. 4a Vector VC-MME432-1 SEQ ID NO: 5 used for cloning gene of interest for targeted expression.
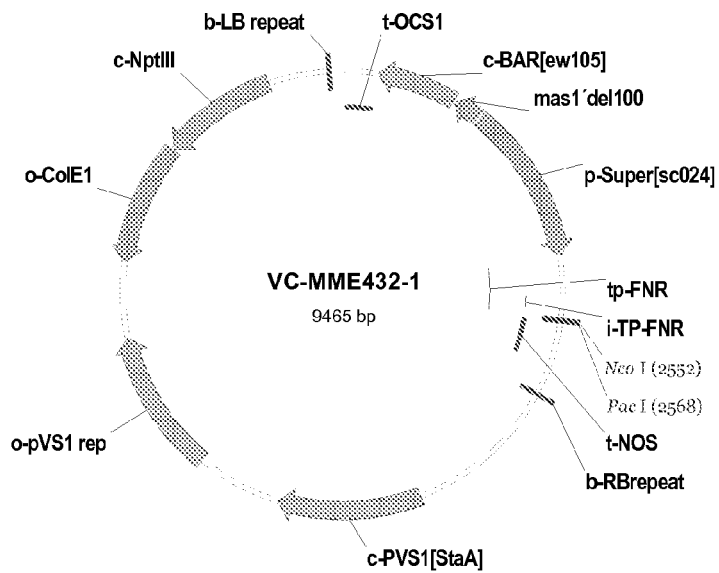
Fig. 4b Vector VC-MME432-1qcz SEQ ID NO: 14393 used for cloning gene of interest for targeted expression.
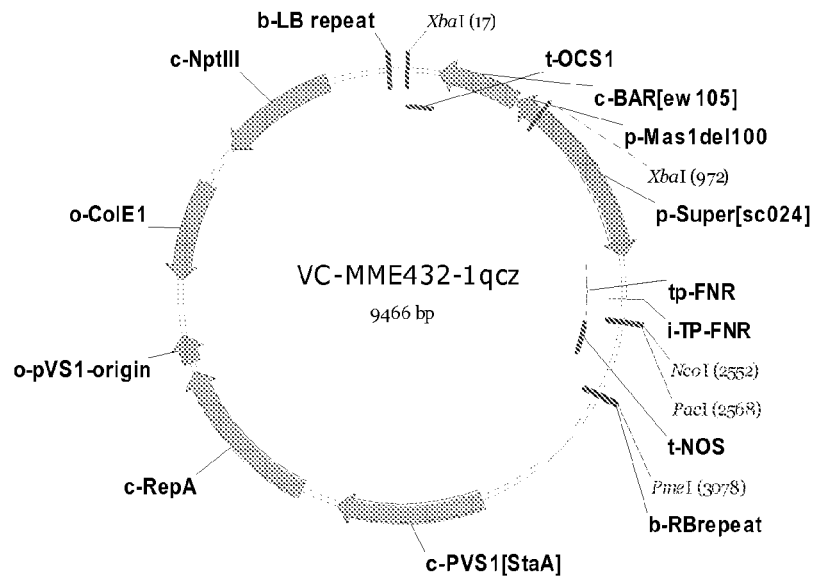

Fig. 5a Vector VC-MME489-1 SEQ ID NO: 15 used for cloning gene of interest for non-targeted expression and cloning of a targeting sequence.
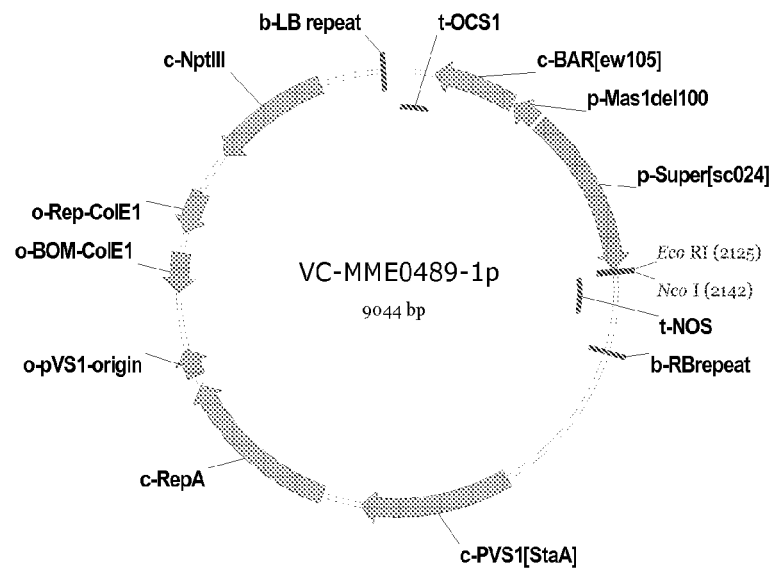
Fig. 5b Vector VC-MME489-1QCZ SEQ ID NO: 14395 used for cloning gene of interest for non-targeted expression and cloning of a targeting sequence.
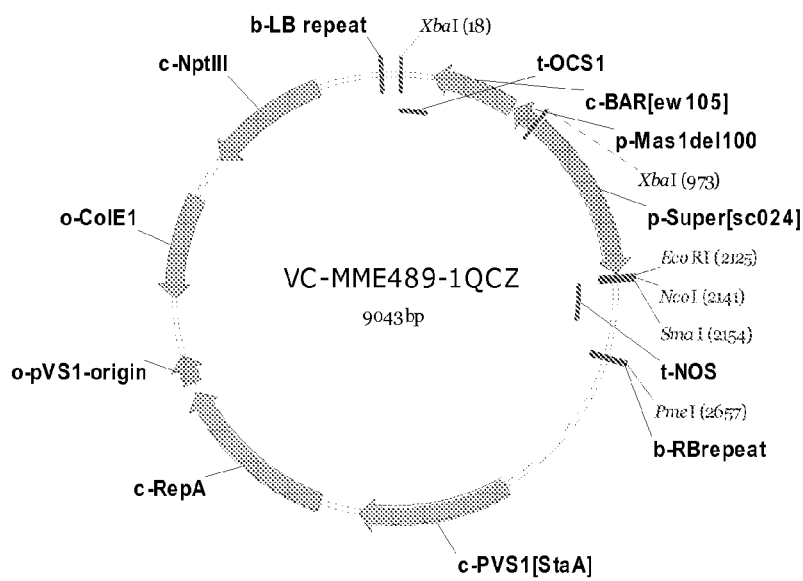

Fig. 6 Vector pMTX02270p SEQ ID NO: 16 used for cloning of a targeting sequence.
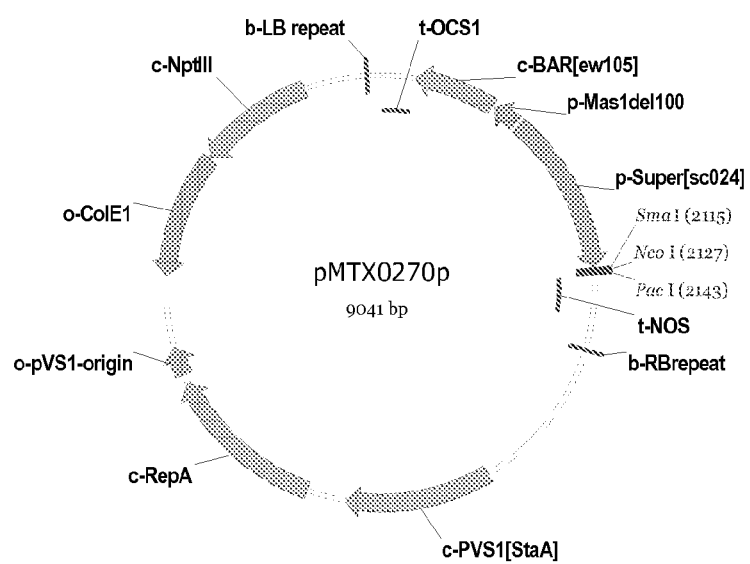

PLANTS WITH INCREASED YIELD

RELATED APPLICATIONS

This application is a national stage application (under 35 U.S.C. §371) of PCT/EP2008/062362, filed Sep. 17, 2008, which claims benefit of European application 07117448.6, filed Sep. 18, 2007 and European application 08161134.5, filed Jul. 25, 2008.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing 13987_00115. The size of the text file is 68,247 KB, and the text file was created on May 21, 2010.

This application incorporates by reference EP 07117448.6 filed on Sep. 18, 2007 and EP 08161134.5 filed on Jul. 25, 2008.

The present invention pertains to the field of molecular biology, plant genetics, plant physiology and developmental biology. More specifically, the present invention disclosed herein provides plant cells comprising nucleic acids enhancing or improving one or more traits of a transgenic plant, plants comprising such cells, progeny, seed and pollen derived from such plants, and methods of making and methods of using such plant cell(s) or plant(s), progeny, seed(s) or pollen. Particularly, said improved trait(s) are manifested in an increased yield, preferably by improving one or more yield-related trait(s).

Under field conditions, plant performance, for example in terms of growth, development, biomass accumulation and seed generation, depends on a plant's tolerance and acclimation ability to numerous environmental conditions, changes and stresses. Since the beginning of agriculture and horticulture, there was a need for improving plant traits in crop cultivation. Besides increasing yield by applying technical advances in crop planting, breeding strategies foster crop properties to withstand biotic and abiotic stresses, to increase nutrient use efficiency and to alter other crop specific yield parameters. The intrinsic growth and development characteristics of plants are improved, tolerance to biotic and abiotic stresses are introduced to maintain yield under environmental stress conditions and to extend acreage under different climatic situations. Crops with better nutrient use efficiency are developed to reduce fertilizer input and also to extend acreage into regions with nutrient poor soil.

Plants are sessile organisms and consequently need to cope with various environmental stresses. Biotic stresses such as plant pests and pathogens on the one hand, and abiotic environmental stresses on the other hand are major limiting factors of plant growth and productivity (Boyer, Plant Productivity and Environment, Science 218, 443-448 (1982); Bohnert et al., Adaptations to Environmental Stresses, Plant Cell 7 (7), 1099-1111 (1995)), thereby limiting plant cultivation and geographical distribution. Plants exposed to the different stresses typically have low yields of plant material, seeds, fruit and other products. Crop losses and crop yield losses of e.g. major crops such as rice, maize (corn), oil seed rape (including winter oil seed rape and canola), cotton, soybean and wheat caused by these stresses represent a significant economic and political factor and contribute to food shortages, particularly in many underdeveloped countries.

Conventional means for crop and horticultural improvements today utilize selective breeding techniques to identify plants with desirable characteristics. Such conventional techniques, however, have several drawbacks. Very often plants contain heterogeneous genetic components that may not always result in the desirable trait being passed on from parent plants, particularly not without other negative impacts. Thus, particularly complex traits such as yield and stress phenomena make genetic optimization by traditional breeding approaches difficult, costly and time-consuming. On the contrary, advances in molecular biology have allowed modifying the germplam of plants in a specific way. The modification of a single gene, for example, resulted in several cases in a significant increase in e.g. stress tolerance (Wang et al., 2003) and other yield-related traits. As different plants have to resist different kinds and strengths of stress in different cultivation areas there is still a need to identify genes which show various combinations of stress resistance to produce optimal yield. There is still a need to identify genes which have the overall capacity to improve yield of plants.

The present invention provides transgenic plant nuclei and/or transgenic plant cells comprising one or more nucleic acid(s) which enhances or improves one or more trait(s) of a transgenic plant, plants comprising such cells, progeny, seed and pollen derived from such plants, and methods of making and methods of using such plant cell(s) or plant(s), progeny, seed(s) or pollen. Particularly, said improved trait(s) are manifested in an increased yield.

In one embodiment, the present invention provides a method for producing such transgenic plant cell(s) or plant(s) with increased yield by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/arylsulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac sub-family of Ras-like proteins, Nuclear cap-binding protein complex subunit, nuclear fusion protein precursor, nuclear pore complex subunit, origin recognition complex sub-unit, outer membrane usher protein, oxidoreductase, peptide transporter, peptidyl-prolyl cis-trans isomerase, PhoH-like protein, phosphatidylserine decarboxylase, phospho-glucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

In a further embodiment, the activity is increased by increasing the amount and/or activity of one or more protein(s) having an activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease; and wherein such one or more protein(s) each comprises a polypeptide as depicted in table II, column 5 or 7.

Said increased yield in accordance with the present invention can typically be achieved by enhancing or improving, in comparison to a non-transformed starting or wild-type plant, one or more yield-related traits of a plant. Such yield-related traits of a plant the improvement of which results in increased yield comprise, without limitation, the increase of the intrinsic yield capacity of a plant, improved nutrient use efficiency, and/or increased stress tolerance.

According to the present invention, yield-related traits concerning an increase of the intrinsic yield capacity of a plant may be manifested by improving the specific (intrinsic) seed yield (e.g. in terms of increased seed/grain size, increased ear number, increased seed number per ear, improvement of seed filling, improvement of seed composition, embryo and/or endosperm improvements, or the like); modification and improvement of inherent growth and development mechanisms of a plant (such as plant height, plant growth rate, pod number, pod position on the plant, number of internodes, incidence of pod shatter, efficiency of nodulation and nitrogen fixation, efficiency of carbon assimilation, improvement of seedling vigour/early vigour, enhanced efficiency of germination (under stressed or non-stressed conditions), improvement in plant architecture, cell cycle modifications, photosynthesis modifications, various signaling pathway modifications, modification of transcriptional regulation, modification of translational regulation, modification of enzyme activities, and the like); and/or the like.

According to the present invention, yield-related traits concerning an improvement or increase in nutrient use efficiency of a plant may be manifested by improving a plant's general efficiency of nutrient assimilation (e.g. in terms of improvement of general nutrient uptake and/or transport, improving a plant's general transport mechanisms, assimilation pathway improvements, and the like), and/or by improving specific nutrient use efficiency of nutrients including, but not limited to, phosphorus, potassium, and nitrogen.

According to the present invention, yield-related traits concerning an improvement or increase of stress tolerance of a plant may be manifested by improving or increasing a plant's tolerance against stress, particularly abiotic stress. In the present application, abiotic stress refers generally to abiotic environmental conditions a plant is typically confronted with, including conditions which are typically referred to as "abiotic stress" conditions including, but not limited to, drought (tolerance to drought may be achieved as a result of improved water use efficiency), heat, low temperatures and cold conditions (such as freezing and chilling conditions), salinity, osmotic stress, shade, high plant density, mechanical stress, oxidative stress, and the like.

According to the present invention, the improvement of yield-related traits relating to an increase of the intrinsic yield capacity of a plant and/or to a plant's tolerance to abiotic stress(es) is a particularly preferred embodiment for enhancing or improving yield of said plant.

The term "yield" as used herein generally refers to a measurable produce from a plant, particularly a crop.

Yield and yield increase (in comparison to a non-transformed starting or wild-type plant) can be measured in a number of ways, and it is understood that a skilled person will be able to apply the correct meaning in view of the particular embodiments, the particular crop concerned and the specific purpose or application concerned.

In the preferred embodiments of the present invention described herein, an increase in yield refers to increased biomass yield, increased seed yield, and/or increased yield regarding one or more specific content(s) of a whole plant or parts thereof or plant seed(s).

In preferred embodiments, "yield" refers to biomass yield comprising dry weight biomass yield and/or fresh weight biomass yield, each with regard to the aerial and/or underground parts of a plant, depending on the specific circumstances (test conditions, specific crop of interest, application of interest, and the like). In each case, biomass yield may be calculated as fresh weight, dry weight or a moisture adjusted basis, and on the other hand on a per plant basis or in relation to a specific area (e.g. biomass yield per acre/square meter/or the like).

In other preferred embodiments, "yield" refers to seed yield which can be measured by one or more of the following parameters: number of seed or number of filled seed (per plant or per area (acre/square meter or the like)); seed filling rate (ratio between number of filled seeds and total number of seeds); number of flowers per plant; seed biomass or total seed weight (per plant or per area (acre/square meter or the like); thousand kernel weight (TKW; extrapolated from the number of filled seeds counted and their total weight; an increase in TKW may be caused by an increased seed size, an increased seed weight, an increased embryo size, and/or an increased endosperm); or other parameters allowing to measure seed yield. Seed yield may be determined on a dry weight or on a fresh weight basis, or typically on a moisture adjusted basis, e.g. at 15.5 percent moisture.

In further preferred embodiments, yield refers to the specific content and/or composition of a harvestable product, including, without limitation, an enhanced and/or improved sugar content or sugar composition, an enhanced or improved starch content and/or starch composition, an enhanced and/or improved oil content and/or oil composition (such as enhanced seed oil content), an enhanced or improved protein content and/or protein composition (such as enhanced seed protein content), an enhanced and/or improved vitamin content and/or vitamin composition, or the like.

In a preferred meaning according to the present application, "yield" as described herein may also refer to the harvestable yield of a plant, which largely depends on the specific plant/crop of interest as well as its intended application (such as food production, feed production, processed food production, biofuel, biogas or alcohol production, or the like) of interest in each particular case. Thus, yield may also be calculated as harvest index (expressed as a ratio of the weight of the respective harvestable parts divided by the total biomass), harvestable parts weight per area (acre, square meter, or the like); and the like.

Preferably, the preferred enhanced or improved yield characteristics of a plant described herein according to the present invention can be achieved in the absence or presence of stress conditions.

The meaning of "yield" is, thus, mainly dependent on the crop of interest and the intended application, and it is understood, that the skilled person will understand in each particular case what is meant from the circumstances of the description.

In a preferred embodiment of the present invention, plant yield is increased by increasing one or more of yield-related traits selected from one or more improvements concerning the nutrient use efficiency of a photosynthetic active organism, especially a plant. An improvement or increase in nutrient use efficiency of a plant may be manifested by improving a plant's general efficiency of nutrient assimilation (e.g. in terms of improvement of general nutrient uptake and/or transport, improving a plant's general transport mechanisms, assimilation pathway improvements, and the like), and/or by improving specific nutrient use efficiency of nutrients including, but not limited to, phosphorus, potassium, and nitrogen.

The term "nutrient deficiency" refers to conditions where the respective photosynthetic organism, especially a plant, lacks of nutrient, like phosphorus, potassium or nitrogen; especially the term "nitrogen deficiency" refers to conditions where the respective photosynthetic organism, especially a plant, lacks of or nitrogen.

In a preferred embodiment the present invention relates to the manipulation of the nitrogen use efficiency in photosynthetic active organisms, preferably in plants. In particular, the present invention relates to a process for the enhanced nitrogen uptake and/or nitrogen utilization, in photosynthetic active organisms, especially in plants. Also the present invention relates to a process for enhanced biomass production, especially under nitrogen limited conditions, in photosynthetic active organisms, especially in plants.

In particular, this invention relates to plant cells and/or plants tailored to grow under conditions of nitrogen deficiency, and/or to plant cells and/or plants showing increased yield when grown under non-nitrogen-deficiency conditions.

The invention also deals with methods of producing and screening for and breeding such plant cells and/or plants.

Plant nutrition is essential to the growth and development of plants and therefore also for quantity and quality of plant products. Because of the strong influence of the efficiency of nutrition uptake as well as nutrition utilization on plant yield and product quality, a huge amount of fertilizer is poured onto soils to optimize plant growth and quality.

Plant growth is primarily limited by three nutrients-phosphorous, potassium and nitrogen. Therefore nitrogen (N) is one of the major nutritional elements required for plant growth, which is usually the rate-limiting element in plant growth. Nitrogen is part of numerous important compounds found in living cells, like amino acids, proteins (e.g. enzymes), nucleic acids, and chlorophyll. 1.5% to 2% of plant dry matter is nitrogen and approximately 16% of total plant protein. Thus, the availability of nitrogen has a major impact on amino acid synthesis as well as amino acid composition, accumulation of amino acids, on protein synthesis and accumulation thereof, and based thereupon it is a major limiting factor for plant growth and yield (Frink C. R., Proc. Natl. Acad Sci. USA 96, 1175 (1999)).

Plants can utilize a wide range of nitrogen species including volatile ammonia ($NH_3$), nitrogen oxides ($NO_x$), mineral nitrogen, like nitrate ($NO_3^-$) and ammonium salts ($NH_4^+$), urea and urea derivates, and organic nitrogen (amino acids, peptides, and the like). Some plants are able to utilize atmospheric nitrogen by symbiotic bacteria or certain fungi. However, in most agricultural soils, nitrate ($NO_3^-$) is the most important source of nitrogen (Crawford N. M., Glass A. D. M., Trends in Plant Science, 3 389 (1998); Hirsch R. E., Sussman M. R., TIBTech 17, 356 (1999)). Nevertheless also ammonium $NH_4^+$ plays an important, probably underestimated role, because most plants preferentially take up $NH_4^+$ when both forms are present—even if $NH_4^+$ is present at lower concentrations than $NO_3^-$ (von Wiren N. et al., Curr. Opin. Plant Biol. 3, 254 (2000)).

Because of the high nitrogen requirements for crop plants, nitrogen fertilization is a major worldwide agricultural investment, with 80 million metric tons of nitrogen fertilizers (as nitrate and/or ammonium) applied annually (Frink C. R., Proc. Natl. Acad Sci. USA 96, 1175 (1999)). There are also negative environmental consequences for the extensive use of nitrogen containing fertilizers in crop production since the crops retain only about two-thirds of the applied nitrogen. Therefore high inputs of fertilizer are followed by large outputs by leaching, gaseous losses and crop removal. The unabsorbed nitrogen can subsequently leach into the soil and contaminate water supplies (Frink C. R., Proc. Natl. Acad Sci. USA 96, 1175 (1999)). Because of the high leaching losses of nitrogen from agricultural ecosystems to surface water and groundwater, nitrogen is also recognized as a pollutant. Nitrogen leaching, namely as nitrate from agricultural lands, affects drinking water quality and causes eutrophication of lakes and coastal areas. Abundant use of nitrogen containing fertilizers can further lead to final deterioration of soil quality, to environmental pollution and health hazards.

Because of the high costs of nitrogen fertilizer in relation to the revenues for agricultural products, and additionally its deleterious effect on the environment, it is desirable to develop strategies to reduce nitrogen input and/or to optimize nitrogen uptake and/or utilization of a given nitrogen availability while simultaneously maintaining optimal yield, productivity and quality of photosynthetic active organisms, preferably cultivated plants, e.g. crops. Also it is desirable to obtain "existing" yield of crops with lower fertilizer input and/or higher yield on soils of similar or even poorer quality.

For efficient nitrogen uptake and utilization, complex processes associated with absorption, translocation, assimilation, and redistribution of nitrogen are required to operate effectively. Differences in nitrogen absorption between genotypes have been demonstrated for several species by different researchers (Chang S. C., Robison D. J., Sci. World J., Suppl. 2, 407 (2001)). Considerable evidence of genotypic differences in nitrogen uptake has also been reported for maize and canola (Weisler et al., Sci. World J., Suppl. 2, 61 (2001); Gallais A., Hirel B., J. Exper. Bot. 55, 295 (2004)).

Plants absorb nitrate via transporters localized to the root epidermal and cortical cell plasma membrane over a wide nitrate concentration range using several different transport mechanisms, including constitutive and nitrate-inducible highaffinity transport systems, as well as nitrate-inducible low-affinity transporters (Stitt M., Curr. Opin. Plant Biol. 2, 178 (1999)). In addition nitrate uptake in plants is highly regulated and coordinated with other transport and metabolic pathways (Crawford N. M. Plant Cell 7, 859 (1995)), and a number of nitrate uptake and assimilation-related genes have been identified and characterized (Forde B. G., Ann. Rev. Plant Biol 53, 203 (2002)). Once in the root cell cytoplasm, nitrate may be stored in the vacuole for later use, transported into the xylem and translocated to the shoot for assimilation and/or storage, released back into the rhizosphere, or reduced to nitrite and then to ammonia via nitrate reductase (NR) and nitrite reductases (NiR). The reduction of nitrate to nitrite and then to ammonia enables the assimilation of nitrogen into amino acids via the GOGAT pathway (Stitt M., Curr. Opin. Plant Biol. 2, 178 (1999)). In order to be incorporated into amino acids, nucleic acids, and other compounds, $NO_3^-$ must be reduced to $NH_4^+$. NR (nitrate reductase) is the first enzyme in the process of $NO_3^-$ reduction to $NH_4^+$. It is a substrate-inducible enzyme and is thought to be the most limiting step in nitrogen assimilation.

The in-situ rate of $NO_3^-$ reduction is controlled primarily by the rate of $NO_3^-$ uptake, rather than by alterations in nitrate reductase activity (NRA) or limitations in reducing power. Thus, $NO_3^-$ uptake appears to be of primary importance in nitrogen assimilation in $NO_3^-$-fed plants. Genetic variation in NRA is well documented in several species. NRA is affected by factors such as environmental conditions and plant developmental stages, as well as plant part, such as roots and tops. Furthermore, in vivo and in vitro assays usually give different results. Variable results were found by several researchers in their efforts to relate NRA to grain yield and N-related traits such as total reduced plant nitrogen, grain nitrogen content, grain nitrogen concentration, and nitrogen harvest index.

Beneath $NO_3^-$ plants can take up nitrogen also in the form of ammonium. Although the average $NH_4^+$ concentrations in soil are often 10 to 1000 times lower than those of $NO_3^-$ (Marschner H. L., "Mineral Nutrition in Higher Plants", London, Academic Press, 1995), the difference in soil concentrations does not necessarily reflect the uptake ratio of each nitrogen source. Plants take up $NH_4^+$ preferentially when both forms —$NO_3^-$ as well as $NH_4^+$—are available, possibly because its assimilation requires less energy since $NO_3^-$ has to be reduced prior to assimilation (Bloom et al., Plant Phys. 1294-1301 (1992)).

Ammonium uptake systems have been characterized in different or ganisms, including yeast and plants. The yeast *Saccharomyces cerevisiae* contains three MEP genes for ammonium transporters, which are all controlled by nitrogen, being repressed in the presence of an nitrogen source that is readily metabolized, such as $NH_4^+$ (Marini et al., Mol. Cell Biol. 17, 4282 (1997)). Plant genes encoding ammonium transport systems have been cloned by complementation of a yeast mutant, homology searches in databases and heterogonous hybridizations (von Wiren N. et al., Curr. Opin. Plant Biol., 3, 254 (2000)). Experimental evidence of the physiological function of $NH_4^+$ transporters mainly rely on correlations between ammonium transporter expression and influx of labeled ammonium. The situation is complicated by the fact, that in *Arabidopsis* but also in other plants ammonium transporters are present in gene families, the members of which have different expression patterns and physiological characteristics. Although DE 43 37 597 claims sequences for plant ammonium transporters and their use for manipulation of the nitrogen metabolism and plant growth under certain conditions, any evidence for positive effects on nitrogen assimilation or plant growth under certain conditions through ectopic expression of the plant ammonium transporters are missing.

Usually the first step in the assimilation of inorganic nitrogen into organic form involves the reaction of glutamate with ammonium to form glutamine being catalyzed by glutamine synthase. Glutamine thus formed may transfer in turn its amino function of the amido group to asparate to form asparagine being catalyzed by asparagine synthase. The steady flow of nitrogen from ammonia to asparagine depends upon the recycling of glutamate, alpha-ketogluterate and aspartate, being catalyzed by glutamine-2-oxoglutarate aminotransferase and aspartate aminotransferase. Glutamine and asparagine represent the major long distance "nitrogen transport compounds" in plants. These are abundant in phloem sap but they have somewhat different roles in plant nitrogen metabolism since glutamine is more metabolic active based on the fact that it can directly transfer its amino function of the amido group to a number of substrates, whereas asparagine is more efficient in "nitrogen transport and storage".

In order to describe the efficiency of the complete pathway of nitrogen, starting with the uptake from the soil, assimilation of nitrogen, transport and accumulation of N-containing compounds within the photosynthetic organism, influencing biomass and yield, different approaches are known. And in the light of the importance of optimal nitrogen use different strategies have been followed for plant optimizations.

In some cases enzymes of the nitrogen assimilation pathway, like of glutamine synthetase, asparagine synthetase and asparaginase, were overexpressed. Although initially unsuccessful like the overexpression of a cytosolic glutamine synthetase gene in *Lotus* (Vincent R. et al., Planta 201, 424 (1997)), recent documents show at least some success. WO 95/09911 describes the overexpression of glutaminesynthetase, asparagine-synthetase and asparaginase in transgenic plant for application in enhanced nitrogen-fixation and improved yield. Chichkova et al. reported in J. Exp. Bot., 52, 2079 (2001) that transgenic tobacco plants that overexpress alfalfa NADH-glutamate-synthase have higher carbon and nitrogen content, but not a specific enrichment in nitrogen in comparison to carbon. In another case, the overexpression of a nitrogen assimilation gene, in this case the *Escherichia coli* glutamate-dehydrogenase, did not lead to a relative increase in nitrogen content, but rather to a significant increase in fresh weight and dry weight. In another case, overexpression of the ASN1 gene enhances the nitrogen status in seeds of *Arabidopsis* (Lam H. et al., Plant Physiol. 321, 926 (2003)). In seeds of those overexpressing lines the authors observed the elevation of soluble seed protein contents, elevation of total protein contents from acid-hydrolyzed seeds and a higher tolerance of young seedlings when grown under nitrogen-limiting conditions.

A different interesting approach was followed by Yanagisawa et al., PNAS 101, 7833 (2004). The authors used hereby the transcription factor Dof1. The overexpression of this regulatory factor induced the up-regulation of genes encoding enzymes for carbon skeleton production, a marked increase of amino acid contents, and a reduction of the glucose level in transgenic *Arabidopsis*. Elementary analysis revealed that the nitrogen content increased in transgenic plants (approximate to 30%), indicating a promotion of net nitrogen assimilation. Most significantly, the Dof1 transgenic plants exhibit improved growth under low-nitrogen conditions. Although looking promising, this approach likely has the drawback, that it relies on a plant transcription factor and the complex corresponding signaling cascade which both might be the subject of different internal regulatory and feedback mechanism modifying or even diminishing the desired effect at least under certain conditions.

Therefore, there is still a need for photosynthetic active organisms, especially plants, that are capable to use nitrogen more efficiently so that less nitrogen is required for the same yield or higher yields may be obtained with current levels of nitrogen use. In addition, there is still a need for photosynthetic active organism, especially plants, that show an increase in biomass and/or yield.

Accordingly, it is also an object of this invention to develop an inexpensive process for an enhanced nitrogen up-take and/or transport and/or assimilation and/or utilisation in a photosynthetic active organism, which are reflected alone or altogether in an increased nitrogen use efficiency (NUE) and/ or a process for an increased biomass production and/or yield under conditions of limited nitrogen supply.

It was found that this object is achieved by providing a process according to the present invention described herein.

It is further an object of this invention to provide plant cells and/or plants, which show an enhanced NUE, and/or exhibit under conditions of limited nitrogen supply an increased biomass production and/or yield, as compared to a corresponding non-transformed wild type plant cell and/or plant.

It was found that this object is achieved by providing plant cells and/or plants according to the present invention described herein.

In one embodiment of the present invention, these traits are achieved by a process for the enhanced nitrogen utilization (=nitrogen use efficiency (NUE)) in a photosynthetic active organism, preferably a plant, as compared to a corresponding non-transformed wild type photosynthetic active organism.

In an embodiment thereof, the term "enhanced NUE" means that the photosynthetic active organism, preferably a plant, exhibits a generally enhanced yield (as defined hereinabove) under normal conditions or under low nutrient conditions, especially an enhanced biomass yield per unit of nitrogen available from the surrounding medium, soil or environment, including nitrogen fertilizer, on which the photosynthetic active or ganism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced dry biomass yield per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced aerial dry biomass yield per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced underground dry biomass yield per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In another embodiment thereof, the term "enhanced NUE" means that the photosynthetic active organism, preferably a plant, exhibits an enhanced fresh weight biomass yield per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced aerial fresh weight biomass yield per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced underground fresh weight biomass yield per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In another embodiment thereof, the term "enhanced NUE" means that the photosynthetic active organism, preferably a plant, exhibits an enhanced yield of harvestable parts of a plant per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced yield of dry harvestable parts of a plant per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced yield of dry aerial harvestable parts of a plant per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced yield of underground dry harvestable parts of a plant per unit of nitrogen available from the surrounding medium, soil or environment, including nitrogen fertilizer, on which the photosynthetic active or ganism, preferably a plant, is grown, as compared to a corresponding non-transformed wild type photosynthetic active organism.

In another embodiment thereof, the term "enhanced NUE" means that the photosynthetic active organism, preferably a plant, exhibits an enhanced yield of fresh weight harvestable parts of a plant per unit of nitrogen available from the surrounding medium, soil or environment, including nitrogen fertilizer, on which the photosynthetic active or ganism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced yield of aerial fresh weight harvestable parts of a plant per unit of nitrogen available from the surrounding medium, soil or environment, including nitrogen fertilizer, on which the photosynthetic active or ganism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced yield of underground fresh weight harvestable parts of a plant per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In a further embodiment, the term "enhanced NUE" means that the photosynthetic active organism, preferably a plant, exhibits an enhanced yield of the crop fruit per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced yield of the fresh crop fruit per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced yield of the dry crop fruit per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced grain dry weight per unit of nitrogen supplied, as compared to a corresponding non-transformed wild type photosynthetic active organism, in analogy to Reynolds, M. P., Ortiz-Monasterio J. J., and McNab A. (eds.), 2001, "Application of Physiology in Wheat Breeding, Mexico, D.F.:CIMMYT, which is incorporated by reference.

In a further embodiment, the term "enhanced NUE" means that the photosynthetic active organism, preferably a plant, exhibits an enhanced yield of seeds per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced yield of fresh weight seeds per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In an embodiment thereof, the term "enhanced NUE" means that the photosynthetic active organism, preferably a plant, exhibits an enhanced yield of dry seeds per unit of nitrogen available from the surrounding medium, soil or environment, including nitrogen fertilizer, on which the photosynthetic active organism, preferably a plant, is grown, as compared to a corresponding non-transformed wild type photosynthetic active organism.

In another embodiment of the present invention, these traits are achieved by a process for an increased biomass production and/or yield under conditions of limited nitrogen supply, in a photosynthetic active organism, preferably plant, as compared to a corresponding non-transformed wild type photosynthetic active or ganism.

In an embodiment thereof, the term "increased biomass production" means that the photosynthetic active organism, especially a plant, exhibit an increased growth rate under conditions of limited nitrogen supply, compared to the corresponding wild-type photosynthetic active organism. An increased growth rate may be reflected inter alia by an increased biomass production of the whole plant, or by an increased biomass production of the aerial parts of a plant, or by an increased biomass production of the underground parts of a plant, or by an increased biomass production of parts of a plant, like stems, leaves, blossoms, fruits, seeds.

In an embodiment thereof, increased biomass production includes higher fruit yields, higher seed yields, higher fresh matter production, and/or higher dry matter production.

In another embodiment thereof, the term "increased biomass production" means that the photosynthetic active organism, preferably plant, exhibits a prolonged growth under conditions of limited nitrogen supply, as compared to the corresponding non-transformed wild type photosynthetic active organism. A prolonged growth comprises survival and/or continued growth of the photosynthetic active organism, preferably plant, at the moment when the non-transformed wild type photosynthetic active organism shows visual symptoms of deficiency and/or death.

In one embodiment of the invention the enhanced NUE is determinated and quantified according to the following method:

Transformed plants are grown in pots in a growth chamber (Svalof Weibull, Svalov, Sweden). In case the plants are *Arabidopsis thaliana* seeds thereof are sown in pots containing a 1:1 (v:v) mixture of nutrient depleted soil ("Einheitserde Typ 0", 30% clay, Tantau, Wansdorf Germany) and sand. Germination is induced by a four day period at 4° C., in the dark. Subsequently the plants are grown under standard growth conditions.

In case the plants are *Arabidopsis thaliana*, the standard growth conditions are: photoperiod of 16 h light and 8 h dark, 20° C., 60% relative humidity, and a photon flux density of 200 µE/m$^2$s. Plants are grown and cultured. In case the plants are *Arabidopsis thaliana* they are watered every second day with a N-depleted nutrient solution. The N-depleted nutrient solution e.g. contains beneath water

| mineral nutrient | final concentration |
|---|---|
| KCl | 3.00 mM |
| MgSO$_4$ × 7 H$_2$O | 0.5 mM |
| CaCl$_2$ × 6 H$_2$O | 1.5 mM |
| K$_2$SO$_4$ | 1.5 mM |
| NaH$_2$PO$_4$ | 1.5 mM |
| Fe-EDTA | 40 µM |
| H$_3$BO$_3$ | 25 µM |
| MnSO$_4$ × H$_2$O | 1 µM |
| ZnSO$_4$ × 7 H$_2$O | 0.5 µM |
| Cu$_2$SO$_4$ × 5 H$_2$O | 0.3 µM |
| Na$_2$MoO$_4$ × 2 H$_2$O | 0.05 µM | but no other N-containing salt.

After 9 to 10 days the plants are individualized. After a total time of 29 to 31 days the plants are harvested and rated by the fresh weight of the aerial parts of the plants, preferably the rosettes.

In another embodiment of the present invention, plant yield is increased by increasing one or more of yield-related traits selected from one or more stress tolerance(s). During its life-cycle, a plant is generally confronted with a diversity of environmental conditions. Any such conditions which may, under certain circumstances, have an impact on plant yield, are herein referred to as "stress" condition. Environmental stresses may generally be divided into biotic and abiotic (environmental) stresses. For the sake of completeness, it is mentioned that unfavorable nutrient conditions are sometimes also referred to as "environmental stress". As will be appreciated by the skilled artisan, the present invention does also contemplate solutions for this kind of environmental stress. This topic is described and dealt with in detail in the paragraphs hereinabove referring to increased nutrient use efficiency.

In a particularly preferred embodiment of the present invention, yield-related traits which can be improved by the present invention are stress tolerance(s).

In a preferred embodiment of the present invention, plant yield is increased by increasing one or more of yield-related traits selected from one or more abiotic stress tolerance(s).

Generally, the term "increased tolerance to stress" can be defined as survival of plants, and/or higher yield production, under stress conditions as compared to a non-transformed wild type or starting plant.

For the purposes of the description of the present invention, the terms "enhanced tolerance to abiotic stress", "enhanced resistance to abiotic environmental stress", "enhanced tolerance to environmental stress", "improved adaptation to environmental stress" and other variations and expressions similar in its meaning are used interchangeably and refer, without limitation, to an improvement in tolerance to one or more abiotic environmental stress(es) as described herein and as compared to a corresponding (non-transformed) wild type (or starting) plant.

In a preferred embodiment of the present invention, plant yield is increased by increasing one or more of yield-related traits selected from one or more abiotic stress tolerance(s). In a particularly preferred embodiment of the present invention, said yield-related trait is increased water use efficiency of a plant and/or increased tolerance to drought conditions.

Drought, heat, cold and salt stress have a common theme important for plant growth and that is water availability. Plants are typically exposed during their life cycle to conditions of reduced environmental water content. Most plants have evolved strategies to protect themselves against these conditions of low water or desiccation. However, if the severity and duration of the drought conditions are too great, the effects on plant development, growth and yield of most crop plants are profound. Continuous exposure to drought causes major alterations in the plant metabolism. These great changes in metabolism ultimately lead to cell death and consequently yield losses.

Developing stress-tolerant plants is a strategy that has the potential to solve or mediate at least some of these problems (McKersie and Leshem, 1994. Stress and Stress Coping in Cultivated Plants, Kluwer Academic Publishers). However, traditional plant breeding strategies to develop new lines of plants that exhibit resistance (tolerance) to these types of stress are relatively slow and require specific resistant lines for crossing with the desired line. Limited germplasm resources for stress tolerance and incompatibility in crosses between distantly related plant species represent significant problems encountered in conventional breeding. Additionally, the cellular processes leading to drought, cold and salt tolerance and/or resistance are complex in nature and involve multiple mechanisms of cellular adaptation and numerous metabolic pathways (McKersie and Leshem, 1994. Stress and Stress Coping in Cultivated Plants, Kluwer Academic Publishers). This multi-component nature of stress tolerance and/or resistance has not only made breeding for tolerance and/or resistance largely unsuccessful.

Plants are exposed during their life cycle also to heat, cold and salt stress. The protection strategies are similar to those of drought resistance. Since high salt content in some soils results in less available water for cell intake, its effect is similar to those observed under drought conditions. Likewise, under freezing temperatures, plant cells loose water as a result of ice formation that starts in the apoplast and withdraws water from the symplast (McKersie and Leshem, 1994. Stress and Stress Coping in Cultivated Plants, Kluwer Academic Publishers). Physiologically these stresses are also interconnected and may induce similar cellular damage. For example drought and salt stress are manifested primarily as osmotic stress, leading to the disruption of homeostasis and ion distribution in the cell (Serrano et al., 1999; Zhu, 2001a; Wang et al., 2003). Oxidative stress, which frequently accompanies high temperature, salinity or drought stress, may cause denaturation of functional or structural proteins (Smirnoff, 1998). As a consequence these abiotic stresses often activate similar signaling pathways (Shinozaki and Ymaguchi-Shinozaki, 2000; Knight and Knight, 2001; Zhu 2001b, 2002) and cellular responses, e.g. the production of certain stress proteins, anti-oxidants and compatible solutes (Vierling and Kimpel, 1992; Zhu et al., 1997; Cushman and Bohnert, 2000).

At the moment many genetical and biotechnological approaches are known in order to obtain plants growing under conditions of low water availability.

These approaches are generally based on the introduction and expression of genes in plant cell coding for different enzymes as disclosed for example in WO 2004/011888, WO 2006/032708, US 20050097640, US 20060037108, US 20050108791, Serrano et al. (Scientia Horticulturae 78, 261-269 (1999)) and many others.

For example the overexpression of antioxidant enzymes or ROS-scavenging enzymes is one possibility to engineer tolerance, e.g. transgenic alfalfa plants expressing Mn-superoxide dismutase tend to have reduced injury after water-deficit stress (McKersie et al., Plant Physiol. 111, 1177-1181 (1996)). These same transgenic plants have increased biomass production in field trials (McKersie et al., Plant Physiology 119, 839-847 (1999); McKersie et al., Plant Physiol. 111, 1177-1181 (1996)). Transgenic plants that overproduce osmolytes such as mannitol, fructans, proline or glycinebetaine also show increased resistance to some forms of abiotic stress and it is proposed that the synthesized osmolytes act as ROS scavengers (Tarczynski. et al. Science 259, 508-510 (1993); Sheveleva, et al., Plant Physiol. 115, 1211-1219 (1997)).

Generally the transformed and stress resistant plants cited exhibit slower growth and reduced biomass, due to an imbalance in development and physiology of the plant, thus having significant fitness cost (Kasuga et al., 1999, Danby and Gehring et al., 2005). Despite maintaining basic metabolic function this leads to severe biomass and yield loss. Sometimes the root/shoot dry weight ratio increases as plant water stress develops. The increase is mostly due to a relative reduction in shoot dry weight. The ratio of seed yield to aboveground dry weight is relatively stable under many environmental conditions and so a robust correlation between plant size and grain yield can often be obtained. These processes are intrinsically linked because the majority of grain biomass is dependent on current stored photosynthetic productivity by the leaves and stem of the plant. Therefore selecting for plant size, even at early stages of development, has been used as an indicator for future potential.

In some cases (US 20060037108) an increased biomass, mainly a greater shoot biomass was observed after a drought treatment by withholding water for 6 to 8 days.

There is still a need to identify genes expressed in stress tolerant plants that have the capacity to confer stress resistance to its host plant and to other plant species, especially to confer increased tolerance and/or resistance to environmental stress, preferably under conditions of water deficiency and confers increased biomass production.

It is an object of this invention to identify new methods to confer stress tolerance and/or resistance in plants or plant cells.

In preferred embodiments of the present invention, thus, abiotic environmental stress refers to drought and low water content, wherein drought stress means any environmental stress which leads to a lack of water in plants or reduction of water supply to plants, including desiccation.

In a further embodiment of the invention the term "increased tolerance to abiotic stress" relates to an increased tolerance to water stress, which is produced as a secondary stress by low temperature and/or salt, and/or as a primary stress during drought or heat.

In accordance with the present invention, in one embodiment, increased tolerance to drought conditions can be determinated and quantified according to the following method:

Transformed plants are grown individually in pots in a growth chamber (York Industriekälte GmbH, Mannheim, Germany). Germination is induced. In case the plants are *Arabidopsis thaliana* sown seeds are kept at 4° C., in the dark, for 3 days in order to induce germination. Subsequently conditions are changed for 3 days to 20° C./6° C. day/night temperature with a 16/8 h day-night cycle at 150 µE. Subsequently the plants are grown under standard growth conditions. In case the plants are *Arabidopsis thaliana*, the standard growth conditions are: photoperiod of 16 h light and 8 h dark, 20° C., 60% relative humidity, and a photon flux density of 200 µE. Plants are grown and cultured until they develop leaves. In case the plants are *Arabidopsis thaliana* they are watered daily until they were approximately 3 weeks old. Starting at that time drought was imposed by withholding water. After the non-transformed wild type plants show visual symptoms of injury, the evaluation starts and plants are scored for symptoms of drought symptoms and biomass production comparison to wild type and neighboring plants for 5-6 days in succession.

Visual symptoms of injury stating for one or any combination of two, three or more of the following features:
a) wilting
b) leaf browning
c) loss of turgor, which results in drooping of leaves or needles stems, and flowers,
d) drooping and/or shedding of leaves or needles,
e) the leaves are green but leaf angled slightly toward the ground compared with controls,
f) leaf blades begun to fold (curl) inward,
g) premature senescence of leaves or needles,
h) loss of chlorophyll in leaves or needles and/or yellowing.

In another preferred embodiment of the present invention, plant yield is increased by increasing one or more of yield-related traits selected from one or more abiotic stress tolerance(s). In a particularly preferred embodiment of the present invention, said yield-related trait is increased tolerance to heat conditions.

In a preferred embodiment of the present invention, plant yield is increased by increasing one or more of yield-related traits selected from one or more abiotic stress tolerance(s). In a particularly preferred embodiment of the present invention, said yield-related trait is increased low temperature tolerance, comprising freezing tolerance and/or chilling tolerance.

Environmental temperatures change within minutes to hours in the diurnal cycle, in hours to days as a result of changing weather, and over weeks to months as a result of seasonal changes. Low temperatures impinge on a plethora of biological processes. They retard or inhibit almost all metabolic and cellular processes, with the typical Q10 for protein-dependent catalysis lying between 2 and 3. They impact on membrane-based processes, because low temperatures alter the physical properties of lipids and reduce membrane fluidity. At temperatures below zero, there is the additional danger of ice formation. This typically takes place in the apoplast of a cell, leading to withdrawal of water and dehydration of the symplast. The response of plants to low temperature is an important determinant of their ecological range. The problem of coping with low temperatures is exacerbated by the need to prolong the growing season beyond the short summer found at high latitudes or altitudes.

Most plants have evolved adaptive strategies to protect themselves against low temperatures. Generally, adaptation to low temperature may be divided into chilling tolerance, and freezing tolerance.

Chilling tolerance is naturally found in species from temperate or boreal zones and allows survival and an enhanced growth at low but non-freezing temperatures. Species from tropical or subtropical zones are chilling sensitive and often show wilting, chlorosis or necrosis, slowed growth and even death at temperatures around 10° C. during one or more stages of development. Freezing tolerance allows survival at near zero to particularly subzero temperatures. It is believed to be promoted by a process termed coldacclimation which occurs at low but non-freezing temperatures and provides increased freezing tolerance at subzero temperatures. In addition, most species from temperate regions have life cycles that are adapted to seasonal changes of the temperature. For those plants, low temperatures may also play an important role in plant development through the process of stratification and vernalisation. It becomes obvious that a clearcut distinction between or definition of chilling tolerance and freezing tolerance is difficult and that the processes may be overlapping or interconnected.

The molecular basis of freezing tolerance has been intensively researched in Arabidopsis. Physiological changes during cold acclimation include changes in lipid composition to increase membrane fluidity, expression of proteins that modify the physical characteristics of membranes, accumulation of compatible solutes like sucrose, raffinose and proline (Cook et al., Proc. Natl. Acad Sci. USA 101, 15243-15248 (2004)), detoxification of active oxygen species and altered leaf development to increase the levels of proteins involved in photosynthetic electron transport and carbon fixation. Some of these changes are specific for low temperature, and others also occur in response to dehydration, mechanical stress.

Less is known about the molecular basis of chilling tolerance at different stages of plant development. Exposure of chilling-sensitive species to low temperatures has a negative impact on seed germination rates as well as early seedling growth and interferes with photosynthesis of the growing plant which may result in photoinhibition. In particular, the process of seed germination strongly depends on environmental temperature and the properties of the seeds determine the level of activity and performance during germination and seedling emergence when being exposed to low temperature. Chilling often delays leaf development and interferes with plastid biogenesis, leading to delayed greening, chlorosis and thickening or deformation of new leaves. Chilling temperatures inhibit respiration, phloem transport, and restrict the utilization of photoassimilate for growth. As one result, sugars and other metabolites accumulate and cause osmotic imbalance.

Chilling tolerance is a major breeding trait because most major crops, particularly corn (maize), bean, rice, soy bean, cotton, tomato, banana, cucumber and potato, are chilling-sensitive.

Breeding of crops with improved adaption to abiotic environmental stresses, and particularly low temperature (i.e. chilling tolerance and/or freezing tolerance), will result in a better trait for stress tolerance and is expected to increase quality and yield of the respective crop. However, the genetic and molecular basis of chilling responses is poorly understood. Although genetic diversity has been identified, for example from landraces and related species that grow at light altitudes, and is being introduced into breeding lines, the genes responsible for the qualitative trait loci have not yet been identified. Additionally, it becomes evident that stress tolerance in plants like low temperature, drought, heat and salt stress tolerance have a common theme important for plant growth, namely the availability of water. Plants are typically exposed during their life cycle to conditions of reduced environmental water content.

The protection strategies are similar to those of chilling tolerance. For example components of low temperature, drought, heat and salt stress are manifested as osmotic stress, leading to the disruption of homeostasis and ion distribution in the cell (Serrano et al., J Exp Bot 50, 1023-1036 (1999); Zhu J. K. Trends Plant Sci 6, 66-71 (2001a); Wang et al., 2003). Under freezing temperatures, plant cells loose water as a result of ice formation that starts in the apoplast and withdraws water from the symplast (McKersie and Leshem, 1994. Stress and Stress Coping in Cultivated Plants, Kluwer Academic Publishers). Oxidative stress, which frequently accompanies low/high temperature, salinity or drought stress, may cause denaturation of functional or structural proteins (Smirnoff, Curr. Opin. Biotech. 9, 214-219 (1998)). As a consequence these abiotic stresses often activate similar signaling pathways (Shinozaki and Ymaguchi-Shinozaki, 2000; Knight and Knight, 2001; Zhu J. K. Curr. Opin Plant Biol. 4, 401-406 (2001b), Zhu, Annu. Rev. Plant Biol. 53, 247-73 (2002)) and cellular responses, e.g. the production of certain stress proteins, anti-oxidants and compatible solutes (Vierling and Kimpel, 1992; Zhu et al., 1997; Cushman and Bohnert, 2000). For example, heat stress shares transcriptional responses that are similar to response pathways induced by other abiotic stresses (e.g. Swindell et al., BMC Genomics, 8, 125 (2007)).

Developing stress-tolerant and/or resistant plants, particularly low temperature tolerant and/or resistant plants, is a strategy that has the potential to solve or mediate at least some of the existing problems (McKersie and Leshem, 1994. Stress and Stress Coping in Cultivated Plants, Kluwer Academic Publishers). However, traditional plant breeding strategies to develop new lines of plants that exhibit tolerance to these types of stress are relatively slow and require specific resistant lines for crossing with the desired line. Limited germplasm resources for stress tolerance and incompatibility in crosses between distantly related plant species represent significant problems encountered in conventional breeding.

Additionally, the cellular processes leading to drought, low temperature and salt tolerance are complex in nature and involve multiple mechanisms of cellular adaptation and numerous metabolic pathways (McKersie and Leshem, 1994. Stress and Stress Coping in Cultivated Plants, Kluwer Academic Publishers). This multicomponent nature of stress tolerance has not only made breeding for tolerance largely unsuccessful, but has also limited the ability to genetically engineer stress tolerance plants using biotechnological methods.

The results of current research indicate that tolerance to low temperature is a complex quantitative trait. The lack of a mechanistic understanding makes it difficult to design a transgenic approach to improve stress tolerance.

At the time the invention was made, a couple of genetical and biotechnological approaches are known in order to obtain plants growing under conditions of low temperature. These approaches are generally based on the introduction and expression of genes in plant cells coding for different enzymes, as disclosed for example in WO 2007/044988, WO 2007/078280, WO 1992/013082, WO 2007/052376, WO 2006/137574.

The overexpression of antioxidant enzymes or ROS-scavenging enzymes is one possibility to engineer tolerance, e.g. transgenic alfalfa plants expressing Mn-superoxide dismutase tend to have reduced injury after water-deficit stress (McKersie et al., Plant Physiol. 111, 1177-1181 (1996)). These same transgenic plants show increased yield in field trials (McKersie et al., 1999. Plant Physiology, 119, 839-847 (1999.); McKersie et al., Plant Physiol. 111, 1177-1181 (1996)). Transgenic plants that overproduce osmolytes such as mannitol, fructans, proline or glycine-betaine also show increased tolerance to some forms of abiotic stress and it is proposed that the synthesized osmolytes act as ROS scavengers (Tarczynski et al., Science 259, 508-510 (1993.); Sheveleva, et al., Plant Physiol. 115, 1211-1219 (1997)).

Nevertheless, the transformed and stress resistant plants cited above generally exhibit slower growth and reduced biomass, due to an imbalance in development and physiology of the plant, thus having significant fitness cost (Kasuga et al., Nature Biotech 17, 287-291 (1999)). Despite maintaining basic metabolic function this leads to severe biomass and yield loss. Sometimes the root/shoot dry weight ratio increase as plant water stress develops. The increase is mostly due to a relative reduction in shoot dry weight. The ratio of seed yield to above-ground dry weight is relatively stable under many environmental conditions and so a robust correlation between plant size and grain yield can often be obtained. These processes are intrinsically linked because the majority of grain biomass is dependent on current stored photosynthetic productivity by the leaves and stem of the plant. Therefore selecting for plant size, even at early stages of development, has been used as an indicator for future yield potential.

Accordingly, for the purposes of the description of the present invention, improved or enhanced "chilling tolerance" or variations thereof refers to improved adaptation to low but non-freezing temperatures around 10° C., preferably temperatures between 1 to 18° C., more preferably 4-14° C., and most preferred 8 to 12° C.; hereinafter called "chilling temperature.

For the purposes of the description of the present invention, improved or enhanced "freezing tolerance" or variations thereof refers to improved adaptation to temperatures near or below zero, namely preferably temperatures below 4° C., more preferably below 3 or 2° C., and particularly preferred at or below 0 (zero) ° C. or below −4° C., or even extremely low temperatures down to −10° C. or lower; hereinafter called "freezing temperature.

More generally, "improved adaptation" to environmental stress like e.g. freezing and/or chilling temperatures refers to an improved plant performance, while plant performance refers to more yield, particularly with regard to one or more of the yield related traits as defined in more detail above.

Accordingly, for the purposes of the description of the present invention, the term "low temperature" with respect to low temperature stress on a plant, and preferably a crop plant, refers to any of the low temperature conditions as described herein, preferably chilling and/or freezing temperatures as defined above, as the context requires. It is understood that a skilled artisan will be able to recognize from the particular context in the present description which temperature or temperature range is meant by "low temperature".

In the present invention, enhanced tolerance to low temperature may, for example and preferably, be determined according to the following method:

Transformed plants are grown in pots in a growth chamber (e.g. York, Mannheim, Germany). In case the plants are *Arabidopsis thaliana* seeds thereof are sown in pots containing a 3.5:1 (v:v) mixture of nutrient rich soil (GS90, Tantau, Wansdorf, Germany) and sand. Plants are grown under standard growth conditions. In case the plants are *Arabidopsis thaliana*, the standard growth conditions are: photoperiod of 16 h light and 8 h dark, 20° C., 60% relative humidity, and a photon flux density of 200 µmol/m²s. Plants are grown and cultured. In case the plants are *Arabidopsis thaliana* they are watered every second day. After 9 to 10 days the plants are individualized. Cold (e.g. chilling at 11-12° C.) is applied 14 days after sowing until the end of the experiment. After a total growth period of 29 to 31 days the plants are harvested and rated by the fresh weight of the aerial parts of the plants, in the case of *Arabidopsis* preferably the rosettes.

In another preferred embodiment of the present invention, plant yield is increased by increasing one or more of yield-related traits selected from one or more abiotic stress tolerance(s). In a particularly preferred embodiment of the present invention, said yield-related trait may also be increased salinity tolerance (salt tolerance), tolerance to osmotic stress, increased shade tolerance, increased tolerance to a high plant density, increased tolerance to mechanical stresses, and/or increased tolerance to oxidative stress.

In another preferred embodiment of the present invention, plant yield is increased by increasing yield in the absence of stress as well as the absence of nutrient deficiencies (=intrinsic yield).

Accordingly, in preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased yield as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased yield as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmo-sensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

In the preferred embodiments of the present invention, yield is increased by improving one or more of the yield-related traits as defined herein.

Accordingly, in an embodiment, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient use efficiency as compared to a corresponding non-transformed wild type plant cell or plant, especially a transgenic plant cell and/or plant with increased NUE and/or increased biomass production as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serinethreonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in particularly preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nutrient use efficiency as compared to a corresponding non-transformed wild type plant cell or plant, especially a transgenic plant cell and/or plant with increased NUE and/or increased biomass production as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

In other particularly preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient use efficiency, especially a transgenic plant cell and/or plant with increased NUE and/or increased biomass production, and an increased stress resistance, particularly abiotic stress resistance, especially an increased low temperature tolerance, in particular an increased tolerance to chilling, and/or an increased water use efficiency, in particular tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-ketoreductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in such other particularly preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient use efficiency, especially a transgenic plant cell and/or plant with increased NUE and/or increased biomass production, and increased stress resistance, particularly abiotic stress resistance, especially an increased low temperature tolerance, in particular an increased tolerance to chilling, and/or an increased water use efficiency, in particular tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helixloop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serinethreonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

Thus, in the most preferred embodiments of the present invention, a method is provided for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency (NUE) and an increased low temperature tolerance, particularly chilling tolerance, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in such most preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency (NUE) and an increased low temperature tolerance, particularly chilling tolerance, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loophelix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

Thus, in the most preferred embodiments of the present invention, a method is provided for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency (NUE) and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serinethreonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in such most preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency (NUE) and an increased water use efficiency (WUE) particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

Thus, in the most preferred embodiments of the present invention, a method is provided for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency (NUE), an increased low temperature tolerance, particularly chilling tolerance, and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serinethreonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in such most preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency (NUE), an increased low temperature tolerance, particularly chilling tolerance and an increased water use efficiency (WUE) particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165- protein, b2238-protein, b2431-protein, 62646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

Accordingly, in an embodiment, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient use efficiency as compared to a corresponding non-transformed wild type plant cell or plant, especially a transgenic plant cell and/or plant with increased NUE and/or increased biomass production as compared to a corresponding non-transformed wild type plant cell or plant, and increased yield in the absence of stress as well as the absence of nutrient deficiencies, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in particularly preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nutrient use efficiency as compared to a corresponding non-transformed wild type plant cell or plant, especially a transgenic plant cell and/or plant with increased NUE and/or increased biomass production as compared to a corresponding non-transformed wild type plant cell or plant, and increased yield in the absence of stress as well as the absence of nutrient deficiencies, by increasing or generating one or more activities selected from the group consisting of 2-dehydro-3-deoxyphosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

In other particularly preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient use efficiency, especially a transgenic plant cell and/or plant with increased NUE and/or increased biomass production, and an increased stress resistance, particularly abiotic stress resistance, especially an increased low temperature tolerance, in particular an increased tolerance to chilling, and/or an increased water use efficiency, in particular tolerance to drought conditions, and increased yield in the absence of stress as well as the absence of nutrient deficiencies, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmo-sensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-ketoreductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in such other particularly preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient use efficiency, especially a transgenic plant cell and/or plant with increased NUE and/or increased biomass production, and an increased stress resistance, particularly abiotic stress resistance, especially an increased low temperature tolerance, in particular an increased tolerance to chilling, and/or an increased water use efficiency, in particular tolerance to drought conditions, and increased yield in the absence of stress as well as the absence of nutrient deficiencies, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helixloop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

Thus, in the most preferred embodiments of the present invention, a method is provided for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency (NUE) and increased yield, in the absence of stress as well as the absence of nutrient deficiencies, and an increased low temperature tolerance, particularly chilling tolerance, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in such most preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency (NUE) and increased yield, in the absence of stress as well as the absence of nutrient deficiencies, and an increased low temperature tolerance, particularly chilling tolerance, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/arylsulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

Thus, in the most preferred embodiments of the present invention, a method is provided for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency (NUE) and increased yield, in the absence of stress as well as the absence of nutrient deficiencies, and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-ketoreductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in such most preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency (NUE) and increased yield, in the absence of stress as well as the absence of nutrient deficiencies, and an increased water use efficiency (WUE) particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyl-transferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

Thus, in the most preferred embodiments of the present invention, a method is provided for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency (NUE), an increased yield, in the absence of stress as well as the absence of nutrient deficiencies, an increased low temperature tolerance, particularly chilling tolerance, and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. Furthermore, in such most preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency (NUE), an increased yield in the absence of stress as well as the absence of nutrient deficiencies, an increased low temperature tolerance, particularly chilling tolerance and an increased water use efficiency (WUE) particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

Among these particularly preferred embodiments of the present invention, the preferred increased nutrient use efficiency achieved in accordance with the methods of the present invention, and shown by the transgenic plant cell nucleus; a transgenic plant cell; plant(s) comprising one or more of such transgenic nuclei or plant cell(s); progeny, seed, and/or pollen derived from such plant cell and/or transgenic plant(s), which are provided by the present invention, is increased nitrogen use efficiency (NUE).

In the preferred embodiments of the present invention described above, it is even more preferred the increase or generation of one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmo-sensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-ketoreductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

For the purpose of the description of the present invention the proteins having an activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/arylsulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal betaketo-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, polypeptides encoded by one or more nucleic acid sequences encoded by one or more nucleic acid sequences as shown in table I, column 5 or 7, and/or the polypeptides as depicted in table II, application no. 1, column 5 or 7 are named as "NUE related protein" NUERP.

Thus, in preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased wild yield as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased yield as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmo-sensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-ketoreductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In these preferred embodiments of the present invention, yield is increased by improving one or more of the yield-related traits as defined herein.

Thus, in particularly preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient use efficiency as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in particularly preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nutrient use efficiency as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, ongin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased NUE and/or increased biomass production, and an increased stress resistance, particularly abiotic stress resistance, especially an increased low temperature tolerance, in particular an increased tolerance to chilling, and/or an increased water use efficiency, in particular tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, 61258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine- 1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such other particularly preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased NUE and/or increased biomass production, and an increased stress resistance, particularly abiotic stress resistance, especially an increased low temperature tolerance, in particular an increased tolerance to chilling, and/or an increased water use efficiency, in particular tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency and an increased low temperature resistance, particularly chilling tolerance, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such even more preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency and an increased low temperature tolerance, particularly chilling tolerance, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, 62646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such even more preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, 62646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency and an increased low temperature resistance, particularly chilling tolerance, and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such even more preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency and an increased low temperature tolerance, particularly chilling tolerance, and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/arylsulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal betaketo-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient efficiency, especially an increased nitrogen use efficiency and/or increased biomass production, and increased yield in the absence of stress as well as the absence of nutrient deficiencies, as compared to the corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such even more preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nutrient efficiency, especially increased nitrogen use efficiency and/or increased biomass production, and an increased in the absence of stress as well as the absence of nutrient deficiencies, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, 62646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient efficiency, especially an increased nitrogen use efficiency and/or increased biomass production, and increased yield in the absence of stress as well as the absence of nutrient deficiencies, as compared to the corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such even more preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nutrient efficiency, especially increased nitrogen use efficiency and/or increased biomass production, and an increased yield in the absence of stress as well as the absence of nutrient deficiencies, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nutrient efficiency, especially an increased nitrogen use efficiency and/or increased biomass production, and an increased stress resistance, particularly abiotic stress resistance, especially an increased low temperature tolerance, in particular an increased tolerance to chilling, and/or an increased water use efficiency, in particular tolerance to drought conditions, and increased yield in the absence of stress as well as the absence of nutrient deficiencies, as compared to the corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/arylsulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such even more preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nutrient efficiency, especially increased nitrogen use efficiency and/or increased biomass production, and an increased stress resistance, particular abiotic stress resistance, especially low temperature tolerance, in particular tolerance to chilling, and/or an increased water use efficiency, in particular tolerance to drought conditions, and an increased yield in the absence of stress as well as the absence of nutrient deficiencies, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/arylsulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency and increased yield in the absence of stress as well as the absence of nutrient deficiencies, and an increased low temperature tolerance, particularly chilling tolerance, as compared to the corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such even more preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency and an increased yield in the absence of stress as well as the absence of nutrient deficiencies, and an increased low temperature tolerance, particularly chilling tolerance, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, 62646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency and increased yield in the absence of stress as well as the absence of nutrient deficiencies, and an increased water use efficiency, particularly tolerance to drought conditions, as compared to the corresponding non-transformed wild type plant cell or plant, by increasing or generating one or more activities selected from the group consisting of 2-dehydro-3-deoxyphosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such even more preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency and an increased yield in the absence of stress as well as the absence of nutrient deficiencies, and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w- protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In other preferred embodiments, the present invention provides a method for producing a transgenic plant cell nucleus; a transgenic plant cell; plant(s) comprising one or more of such transgenic nuclei or plant cell(s); progeny, seed, and/or pollen derived from such plant cell and/or transgenic plant(s); each showing an increased nitrogen use efficiency, increased yield in the absence of stress as well as the absence of nutrient deficiencies, an increased low temperature tolerance, particularly chilling tolerance, and an increased water use efficiency, particularly tolerance to drought conditions, as compared to the corresponding non-transformed wild type plant cell or plant, by increasing or generating one or more activities selected from the group consisting of 2-dehydro-3-deoxyphosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7. Furthermore, in such even more preferred embodiments, the present invention provides a transgenic plant cell nucleus; a transgenic plant cell; plant(s) comprising one or more of such transgenic nuclei or plant cell(s); progeny, seed, and/or pollen derived from such plant cell and/or transgenic plant(s); each showing increased nitrogen use efficiency, an increased yield in the absence of stress as well as the absence of nutrient deficiencies, an increased low temperature tolerance, particularly chilling tolerance, and an increased water use efficiency, particularly tolerance to drought conditions, as compared to a corresponding non-transformed wild type plant cell or plant, by increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease, which is effected by one or more nucleic acid sequences as shown in table I, column 5 or 7, by one or more proteins each comprising a polypeptide encoded by one or more nucleic acid sequences as shown in table I, column 5 or 7, and/or by one or more protein(s) each comprising a polypeptide as depicted in table II, column 5 or 7.

In a preferred embodiment of the invention a photosynthetic active organism, especially a plant, shows an enhanced NUE.

In another preferred embodiment a photosynthetic active organism, especially a plant, shows increased biomass production and/or yield under conditions of limited nitrogen supply.

In another embodiment this invention fulfills the need to identify new, unique genes capable of effecting an increased yield in a plant upon expression or over-expression of endogenous and/or exogenous genes.

In preferred embodiments thereof, this invention fulfills the need to identify new, unique genes capable of effecting an increased yield in a plant upon expression or over-expression of one or more endogenous genes.

In preferred embodiments thereof, this invention fulfills the need to identify new, unique genes capable of effecting an increased yield in a plant upon expression or over-expression of one or more exogenous genes.

In another embodiment this invention fulfills the need to identify new, unique genes capable of effecting an increased nutrient efficiency, especially an increased NUE, and an increased stress resistance, particularly abiotic stress resistance, especially an increased low temperature tolerance, in particular an increased tolerance to chilling, and/or an increased water use efficiency, in particular tolerance to drought conditions, in a plant upon expression or over-expression of endogenous and/or exogenous genes.

In preferred embodiments thereof, this invention fulfills the need to identify new, unique genes capable of effecting an increased nutrient efficiency, especially an increased NUE, and an increased stress resistance, particularly abiotic stress resistance, especially an increased low temperature tolerance, in particular an increased tolerance to chilling, and/or an increased water use efficiency, in particular tolerance to drought conditions, in a plant upon expression or over-expression of one or more endogenous genes.

In preferred embodiments thereof, this invention fulfills the need to identify new, unique genes capable of effecting an increased nutrient efficiency, especially an increased NUE, and an increased stress resistance, particularly abiotic stress resistance, especially an increased low temperature tolerance, in particular an increased tolerance to chilling, and/or an increased water use efficiency, in particular tolerance to drought conditions, in a plant upon expression or over-expression of one or more exogenous genes.

In another embodiment this invention fulfills the need to identify new, unique genes capable of effecting an increased NUE, and an increased low temperature tolerance, in particular an increased tolerance to chilling, in a plant upon expression or over-expression of endogenous and/or exogenous genes.

In preferred embodiments thereof, this invention fulfills the need to identify new, unique genes capable of effecting an increased NUE, and an increased low temperature tolerance, in particular an increased tolerance to chilling, in a plant upon expression or over-expression of one or more endogenous genes.

In preferred embodiments thereof, this invention fulfills the need to identify new, unique genes capable of effecting an increased NUE, and an increased low temperature tolerance, in particular an increased tolerance to chilling, in a plant upon expression or over-expression of one or more exogenous genes.

In another embodiment this invention fulfills the need to identify new, unique genes capable of effecting an increased NUE, and an increased water use efficiency, in particular tolerance to drought conditions, in a plant upon expression or over-expression of endogenous and/or exogenous genes.

In preferred embodiments thereof, this invention fulfills the need to identify new, unique genes capable of effecting an increased NUE, and an increased water use efficiency, in particular tolerance to drought conditions, in a plant upon expression or over-expression of one or more endogenous genes.

In preferred embodiments thereof, this invention fulfills the need to identify new, unique genes capable of effecting an increased NUE, and an increased water use efficiency, in particular tolerance to drought conditions, in a plant upon expression or over-expression of one or more exogenous genes.

In another embodiment this invention fulfills the need to identify new, unique genes capable of effecting an increased NUE, an increased low temperature tolerance, in particular an increased tolerance to chilling, and an increased water use efficiency, in particular tolerance to drought conditions, in a plant upon expression or over-expression of endogenous and/or exogenous genes.

In preferred embodiments thereof, this invention fulfills the need to identify new, unique genes capable of effecting an increased NUE, an increased low temperature tolerance, in particular an increased tolerance to chilling, and an increased water use efficiency, in particular tolerance to drought conditions, in a plant upon expression or over-expression of one or more endogenous genes.

In preferred embodiments thereof, this invention fulfills the need to identify new, unique genes capable of effecting an increased NUE, an increased low temperature tolerance, in particular an increased tolerance to chilling, and an increased water use efficiency, in particular tolerance to drought conditions, in a plant upon expression or over-expression of one or more exogenous genes.

In another embodiment this invention fulfills the need to identify new, unique genes capable of effecting an increased nutrient efficiency, especially an increased NUE, and an increased yield in the absence of stress as well as the absence of nutrient deficiencies, in a plant upon expression or over-expression of endogenous and/or exogenous genes.

In preferred embodiments thereof, this invention fulfills the need to identify new, unique genes capable of effecting an increased nutrient efficiency, especially an increased NUE, and an increased yield in the absence of stress as well as the absence of nutrient deficiencies, in a plant upon expression or over-expression of one or more endogenous genes.

In preferred embodiments thereof, this invention fulfills the need to identify new, unique genes capable of effecting an increased nutrient efficiency, especially an increased NUE, and an increased yield in the absence of stress as well as the absence of nutrient deficiencies, in a plant upon expression or over-expression of one or more exogenous genes.

In another embodiment this invention fulfills the need to identify new, unique genes capable of effecting an increased nutrient efficiency, especially an increased NUE, an increased stress resistance, particularly abiotic stress resistance, especially an increased low temperature tolerance, in particular an increased tolerance to chilling, and/or an increased water use efficiency, in particular tolerance to drought conditions, and an increased yield in the absence of stress as well as the absence of nutrient deficiencies, in a plant upon expression or over-expression of endogenous and/or exogenous genes.

In preferred embodiments thereof, this invention fulfills the need to identify new, unique genes capable of effecting an increased nutrient efficiency, especially an increased NUE, and an increased stress resistance, particularly abiotic stress resistance, especially an increased low temperature tolerance, in particular an increased tolerance to chilling, and/or an increased water use efficiency, in particular tolerance to drought conditions, and an increased yield in the absence of stress as well as the absence of nutrient deficiencies, in a plant upon expression or over-expression of one or more endogenous genes.

In preferred embodiments thereof, this invention fulfills the need to identify new, unique genes capable of effecting an increased nutrient efficiency, especially an increased NUE, and an increased stress resistance, particularly abiotic stress resistance, especially an increased low temperature tolerance, in particular an increased tolerance to chilling, and/or an increased water use efficiency, in particular tolerance to drought conditions, and an increased yield in the absence of stress as well as the absence of nutrient deficiencies, in a plant upon expression or over-expression of one or more exogenous genes.

In another embodiment this invention fulfills the need to identify new, unique genes capable of effecting an increased NUE, an increased low temperature tolerance, in particular an increased tolerance to chilling, and an increased yield in the absence of stress as well as the absence of nutrient deficiencies, in a plant upon expression or over-expression of endogenous and/or exogenous genes.

In preferred embodiments thereof, this invention fulfills the need to identify new, unique genes capable of effecting an NUE, an increased low temperature tolerance, in particular an increased tolerance to chilling, and an increased yield in the absence of stress as well as the absence of nutrient deficiencies, in a plant upon expression or over-expression of one or more endogenous genes.

In preferred embodiments thereof, this invention fulfills the need to identify new, unique genes capable of effecting an increased NUE, an increased low temperature tolerance, and an increased yield in the absence of stress as well as the absence of nutrient deficiencies, in a plant upon expression or over-expression of one or more exogenous genes.

In another embodiment this invention fulfills the need to identify new, unique genes capable of effecting an increased NUE, an increased water use efficiency, in particular tolerance to drought conditions, and an increased yield in the absence of stress as well as the absence of nutrient deficiencies, in a plant upon expression or over-expression of endogenous and/or exogenous genes.

In preferred embodiments thereof, this invention fulfills the need to identify new, unique genes capable of effecting an increased NUE, an increased water use efficiency, in particular tolerance to drought conditions, and an increased yield in the absence of stress as well as the absence of nutrient deficiencies, in a plant upon expression or over-expression of one or more endogenous genes.

In preferred embodiments thereof, this invention fulfills the need to identify new, unique genes capable of effecting an increased NUE, an increased water use efficiency, in particular tolerance to drought conditions, and an increased yield in the absence of stress as well as the absence of nutrient deficiencies, in a plant upon expression or over-expression of one or more exogenous genes.

In another embodiment this invention fulfills the need to identify new, unique genes capable of effecting an increased NUE, an increased low temperature tolerance, in particular an increased tolerance to chilling, an increased water use efficiency, in particular tolerance to drought conditions, and an increased yield in the absence of stress as well as the absence of nutrient deficiencies, in a plant upon expression or over-expression of endogenous and/or exogenous genes.

In preferred embodiments thereof, this invention fulfills the need to identify new, unique genes capable of effecting an increased NUE, an increased low temperature tolerance, in particular an increased tolerance to chilling, an increased water use efficiency, in particular tolerance to drought conditions, and an increased yield in the absence of stress as well as the absence of nutrient deficiencies, in a plant upon expression or over-expression of one or more endogenous genes.

In preferred embodiments thereof, this invention fulfills the need to identify new, unique genes capable of effecting an increased NUE, an increased low temperature tolerance, in particular an increased tolerance to chilling, an increased water use efficiency, in particular tolerance to drought conditions, and an increased yield in the absence of stress as well as the absence of nutrient deficiencies, in a plant upon expression or over-expression of one or more exogenous genes.

In another embodiment this invention fulfills the need to identify new, unique genes capable of conferring enhanced nutrient efficiency, especially enhanced NUE, to photosynthetic active organism, preferably plants, upon expression or over-expression of one or more endogenous and/or exogenous genes.

In another embodiment thereof this invention fulfills the need to identify new, unique genes capable of conferring enhanced nutrient efficiency, especially enhanced NUE, to photosynthetic active organism, preferably plants, upon expression or over-expression of one or more endogenous genes.

In another embodiment thereof this invention fulfills the need to identify new, unique genes capable of conferring enhanced nutrient efficiency, especially enhanced NUE, to photosynthetic active organism, preferably plants, upon expression or over-expression of one or more exogenous genes.

In another embodiment this invention fulfills the need to identify new, unique genes capable of conferring an increase of biomass production to photosynthetic active or ganism, preferably plants, upon expression or over-expression of one or more endogenous and/or exogenous genes.

In another embodiment thereof this invention fulfills the need to identify new, unique genes capable of conferring an increase of biomass production to photosynthetic active organism, preferably plants, upon expression or over-expression of one or more endogenous genes.

In another embodiment thereof this invention fulfills the need to identify new, unique genes capable of conferring an increase of biomass production to photosynthetic active organism, preferably plants, upon expression or over-expression of one or more exogenous genes.

In another embodiment this invention fulfills the need to identify new, unique genes capable of conferring an enhanced NUE in combination with an increase of biomass production to photosynthetic active organism, preferably plants, upon expression or over-expression of one or more endogenous and/or exogenous genes.

In another embodiment thereof this invention fulfills the need to identify new, unique genes capable of conferring an enhanced NUE in combination with an increase of biomass production to photosynthetic active organism, preferably plants, upon expression or over-expression of one or more endogenous genes.

In another embodiment this invention fulfills the need to identify new, unique genes capable of conferring an enhanced NUE in combination with an increase of biomass production to photosynthetic active organism, preferably plants, upon expression or over-expression of one or more exogenous genes.

Thus, in the most preferred embodiments of the present invention, this invention fulfills the need to identify new, unique genes capable of effecting an increased nitrogen use efficiency (NUE), optionally an increased low temperature tolerance, particularly chilling tolerance, optionally an increased water use efficiency, in particular tolerance to drought conditions, and optionally an increased yield in the absence of stress as well as the absence of nutrient deficiencies. In each of the above described preferred embodiments, it is preferred that said genes of the invention have the capacity of increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetylglucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. In these preferred embodiments of the present invention, it is even more preferred that the increase or generation of one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helixloop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease is effected by one or more nucleic acid sequences as shown in table I, column 5 or 7, by one or more proteins encoded by one or more nucleic acid sequences as shown in table I, column 5 or 7, and/or by one or more protein(s) as depicted in table II, column 5 or 7. The need to identify such new, unique genes is particularly fulfilled by providing the NUERP encoding genes disclosed herein.

Accordingly, the present invention relates to a method for producing a transgenic photosynthetic active organism or a part thereof, preferably a plant cell, a plant or a part thereof, resulting in increased yield, preferably with enhanced NUE and/or increased biomass production, as compared to a corresponding non-transformed wild type photosynthetic active organism or a part thereof, preferably a plant cell, a plant or a part thereof, which comprises
(a) increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidylprolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR2090-protein, YMR233W-protein, YNL320W-protein, YOR097C-protein, YOR203W-protein, YPL068C-protein, Zinc finger protein, and zinc metalloprotease. in a photosynthetic active organism or a part thereof, preferably a plant cell, a plant or a part thereof, and (b) growing the photosynthetic active organism or a part thereof, preferably a plant cell, a plant or a part thereof under conditions which permit the development of a photosynthetic active organism or a part thereof, preferably a plant cell, a plant or a part thereof, showing increased yield, preferably enhanced NUE and/or increased biomass production, as compared to a corresponding non-transformed wild type photosynthetic active organism or a part thereof, preferably a plant cell, a plant or a part thereof.

In an further embodiment, the present invention relates to a method for producing a transgenic plant cell nucleus, a transgenic plant cell, a transgenic plant or a part thereof, resulting in increased yield as compared to a corresponding non-transformed wild type plant cell, a transgenic plant or a part thereof, which comprises (a) increasing or generating, in said plant cell nucleus, plant cell, plant or part thereof, one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209O-protein, YMR233W-protein, YNL320W-protein, YOR097C-protein, YOR203W-protein, YPL068C-protein, Zinc finger protein, and zinc metalloprotease;

(b) growing a plant cell, a plant or a part thereof under conditions, preferably in presence or absence of nutrient deficiency and/or abiotic stress, which permits the development of a plant cell, a plant or a part thereof, showing increased yield as compared to a corresponding non-transformed wild type plant cell, a transgenic plant or a part thereto, and (c) selecting the plant cell, a plant or a part thereof, showing increased yield, preferably improved nutrient use efficiency and/or abiotic stress resistance, as compared to a corresponding non-transformed wild type plant cell, a transgenic plant or a part thereof which shows visual symptoms of deficiency and/or death under said conditions.

In an embodiment the present invention relates to a method for producing a transgenic photosynthetic active organism or a part thereof, preferably a plant cell, a plant or a part thereof with enhanced NUE and/or increased biomass production, as compared to a corresponding non-transformed wild type photosynthetic active or ganism or a part thereof, preferably a plant cell, a plant or a part thereof, which comprises (a) increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidylprolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease. in a photosynthetic active organism or a part thereof, preferably a plant cell, a plant or a part thereof, (b) growing the photosynthetic active organism or a part thereof, preferably a plant cell, a plant or a part thereof together with non-transformed wildtype photosynthetic active organism or a part thereof, preferably a plant, under conditions of limited nitrogen supply, and (c) selecting the photosynthetic active organism or a part thereof, preferably a plant cell, a plant or a part thereof, with enhanced NUE and/or increased biomass production, as compared to a corresponding non-transformed wild type photosynthetic active organism or a part thereof, preferably a plant cell, a plant or a part thereof, after the non-transformed wild type photosynthetic active organism or a part thereof, preferably a plant cell, a plant or a part thereof, show visual symptoms of deficiency and/or death.

In one embodiment the present invention relates to a method for producing a transgenic photosynthetic active organism or a part thereof, preferably plant cell nucleus, a plant cell, a plant or a part thereof, resulting in increased yield, especially enhanced NUE and/or increased biomass production, as compared to a corresponding non-transformed wild type photosynthetic active organism or a part thereof, preferably a plant cell, a plant or a part thereof, which comprises (a) increasing or generating the activity of a protein as shown in table II, application no. 1, column 3, preferably encoded by the nucleic acid sequences as shown in table I, application no. 1, column 5, in photosynthetic active organism or a part thereof, preferably a plant cell nucleus, a plant cell, a plant or a part thereof, and (b) growing the photosynthetic active organism or a part thereof, preferably a plant cell, a plant or a part thereof under conditions which permit the development of a plant showing increased yield, especially enhanced NUE and/or increased biomass production, as compared to a corresponding non-transformed wild type photosynthetic active organism or a part thereof, preferably a plant.

Accordingly, the present invention relates to a method for producing a transgenic plant cell, a plant or a part thereof, resulting in increased yield, especially enhanced NUE and/or increased biomass production, as compared to a corresponding non-transformed wild type plant cell, a plant or a part thereof, which comprises (a) increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, 60165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidylprolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease in an organelle, especially the plastid, of a plant cell, and (b) growing the plant cell under conditions which permit the development of a plant showing increased yield, especially enhanced NUE and/or increased biomass production, as compared to a corresponding non-transformed wild type plant.

In another embodiment the present invention relates to a method for producing a transgenic plant cell, a plant or a part thereof, resulting in increased yield, especially enhanced NUE and/or increased biomass production, as compared to a corresponding non-transformed wild type plant cell, a plant or a part thereof, which comprises (a) increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidylprolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease in the cytosol of a plant cell, and (b) growing the plant cell under conditions which permit the development of a plant showing increased yield, especially enhanced NUE and/or increased biomass production, as compared to a corresponding non-transformed wild type plant.

In one embodiment the present invention relates to a method for producing a transgenic plant cell, a plant or a part thereof, resulting in increased yield, especially enhanced NUE and/or increased biomass production, as compared to a corresponding non-transformed wild type plant cell, a plant or a part thereof, which comprises (a) increasing or generating the activity of a protein as shown in table II, application no. 1, column 3, preferably encoded by the nucleic acid sequences as shown in table I, application no. 1, column 5 or 7, in an organelle, especially in the plastid, of a plant cell, and (b) growing the plant cell under conditions which permit the development of a plant showing increased yield, especially enhanced NUE and/or increased biomass production, as compared to a corresponding non-transformed wild type plant.

In one embodiment the present invention relates to a method for producing a transgenic plant cell, a plant or a part thereof, resulting in increased yield, especially enhanced NUE and/or increased biomass production, as compared to a corresponding non-transformed wild type plant cell, a plant or a part thereof, which comprises (a) increasing or generating the activity of a protein as shown in table II, application no. 1, column 3, preferably encoded by the nucleic acid sequences as shown in table I, application no. 1, column 5 or 7, in the cytosol of a plant cell, and
(b) growing the plant cell under conditions which permit the development of a plant showing increased yield, especially enhanced NUE and/or increased biomass production, as compared to a corresponding non-transformed wild type plant.

In another embodiment the present invention is related to a method for producing a transgenic plant cell, a plant or a part thereof, resulting in increased yield, especially enhanced NUE and/or increased biomass production, as compared to a corresponding non-transformed wild type plant cell, a plant or a part thereof, which comprises (a) increasing or generating one or more activities selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidylprolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR2090-protein, YMR233W-protein, YNL320W-protein, YOR097C-protein, YOR203W-protein, YPL068C-protein, Zinc finger protein, and zinc metalloprotease. in an organelle of a plant cell; or (b) increasing or generating the activity of a protein as shown in table II, application no. 1, column 3 encoded by the nucleic acid sequences as shown in table I, application no. 1, column 5 or 7, which are joined to a nucleic acid sequence encoding a transit peptide in a plant cell; or (c) increasing or generating the activity of a protein as shown in table II, application no. 1, column 3 encoded by the nucleic acid sequences as shown in table I, application no. 1, column 5 or 7, which are joined to a nucleic acid sequence encoding an organelle localization sequence, especially a chloroplast localization sequence, in a plant cell, and (d) growing the plant cell under conditions which permit the development of a plant showing increased yield, especially enhanced NUE and/or increased biomass production, as compared to a corresponding non-transformed wild type plant.

In another embodiment, the present invention relates to a method for producing a transgenic plant cell, a plant or a part thereof, resulting in increased yield, especially enhanced nutrient efficiency, in particular enhanced NUE and/or increased biomass production, and optionally resulting in increased stress tolerance, especially abiotic stress tolerance, preferably low temperature tolerance and/or increased water use efficiency, as compared to a corresponding non-transformed wild type plant cell, a plant or a part thereof, which comprises (a) increasing or generating the activity of a protein as shown in table II, application no. 1, column 3 encoded by the nucleic acid sequences as shown in table I, application no. 1, column 5 or 7, in an organelle of a plant through the transformation of the organelle, or (b) increasing or generating the activity of a protein as shown in table II, application no. 1, column 3 encoded by the nucleic acid sequences as shown in table I, application no. 1, column 5 or 7 in the plastid of a plant, or in one or more parts thereof through the transformation of the plastids; and (c) growing the plant cell under conditions which permit the development of a plant showing increased yield, especially enhanced nutrient efficiency, in particular enhanced NUE and/or increased biomass production, and optionally resulting in increased stress tolerance, especially abiotic stress tolerance, preferably low temperature tolerance and/or increased water use efficiency, as compared to a corresponding non-transformed wild type plant.

In principle the nucleic acid sequence encoding a transit peptide can be isolated from every organism such as microorganisms such as algae or plants containing plastids preferably chloroplasts. A "transit peptide" is an amino acid sequence, whose encoding nucleic acid sequence is translated together with the corresponding structural gene. That means the transit peptide is an integral part of the translated protein and forms an amino terminal extension of the protein. Both are translated as so called "preprotein". In general the transit peptide is cleaved off from the preprotein during or just after import of the protein into the correct cell organelle such as a plastid to yield the mature protein. The transit peptide ensures correct localization of the mature protein by facilitating the transport of proteins through intracellular membranes.

Preferred nucleic acid sequences encoding a transit peptide are derived from a nucleic acid sequence encoding a protein finally resided in the plastid and stemming from an organism selected from the group consisting of the genera *Acetabularia, Arabidopsis, Brassica, Capsicum, Chlamydomonas, Cururbita, Dunaliella, Euglena, Flayeria, Glycine, Helianthus, Hordeum, Lemna, Lolium, Lycopersion, Malus, Medicago, Mesembryanthemum, Nicotiana, Oenotherea, Oryza, Petunia, Phaseolus, Physcomitrella, Pinus, Pisum, Raphanus, Silene, Sinapis, Solanum, Spinacea, Stevia, Synechococcus, Triticum* and *Zea*.

Advantageously such transit peptides, which are beneficially used in the inventive process, are derived from the nucleic acid sequence encoding a protein selected from the group consisting of ribulose bisphosphate carboxylase/oxygenase, 5-enolpyruvyl-shikimate-3-phosphate synthase, acetolactate synthase, chloroplast ribosomal protein CS17, Cs protein, ferredoxin, plastocyanin, ribulose bisphosphate carboxylase activase, tryptophan synthase, acyl carrier protein, plastid chaperonin-60, cytochrome $c_{552}$, 22-kDA heat shock protein, 33-kDa Oxygen-evolving enhancer protein 1, ATP synthase γ subunit, ATP synthase δ subunit, chlorophyll-a/b-binding proteinII-1, Oxygen-evolving enhancer protein 2, Oxygen-evolving enhancer protein 3, photosystem I: P21, photosystem I: P28, photosystem I: P30, photosystem I: P35, photosystem I: P37, glycerol-3-phosphate acyltransferases, chlorophyll a/b binding protein, CAB2 protein, hydroxymethyl-bilane synthase, pyruvate-orthophosphate dikinase, CAB3 protein, plastid ferritin, ferritin, early light-inducible protein, glutamate-1-semialdehyde aminotransferase, protochlorophyllide reductase, starch-granule-bound amylase synthase, light-harvesting chlorophyll a/b-binding protein of photosystem II, major pollen allergen Lol p 5a, plastid ClpB ATP-dependent protease, superoxide dismutase, ferredoxin NADP oxidoreductase, 28-kDa ribonucleoprotein, 31-kDa ribonucleoprotein, 33-kDa ribonucleoprotein, acetolactate synthase, ATP synthase $CF_0$ subunit 1, ATP synthase $CF_0$ subunit 2, ATP synthase $CF_0$ subunit 3, ATP synthase $CF_0$ subunit 4, cytochrome f, ADP-glucose pyrophosphorylase, glutamine synthase, glutamine synthase 2, carbonic anhydrase, GapA protein, heat-shock-protein hsp21, phosphate translocator, plastid ClpA ATP-dependent protease, plastid ribosomal protein CL24, plastid ribosomal protein CL9, plastid ribosomal protein PsCL18, plastid ribosomal protein PsCL25, DAHP synthase, starch phosphorylase, root acyl carrier protein II, betainealdehyde dehydrogenase, GapB protein, glutamine synthetase 2, phosphoribulokinase, nitrite reductase, ribosomal protein L12, ribosomal protein L13, ribosomal protein L21, ribosomal protein L35, ribosomal protein L40, triose phosphate-3-phosphoglyerate-phosphate translocator, ferredoxin-dependent glutamate synthase, glyceraldehyde-3-phosphate dehydrogenase, NADP-dependent malic enzyme and NADP-malate dehydrogenase.

More preferred the nucleic acid sequence encoding a transit peptide is derived from a nucleic acid sequence encoding a protein finally resided in the plastid and stemming from an organism selected from the group consisting of the species *Acetabularia mediterranea, Arabidopsis thaliana, Brassica campestris, Brassica napus, Capsicum annuum, Chlamydomonas reinhardtii, Cururbita moschata, Dunaliella salina, Dunaliella tertiolecta, Euglena gracilis, Flayeria trinervia, Glycine max, Helianthus annuus, Hordeum vulgare, Lemna gibba, Lolium perenne, Lycopersion esculentum, Malus domestica, Medicago falcata, Medicago sativa, Mesembryanthemum crystal linum, Nicotiana plumbaginifolia, Nicotiana sylvestris, Nicotiana tabacum, Oenotherea hookeri, Oryza sativa, Petunia hybrida, Phaseolus vulgaris, Physcomitrella patens, Pinus tunbergii, Pisum sativum, Raphanus sativus, Silene pratensis, Sinapis alba, Solanum tuberosum, Spinacea oleracea, Stevia rebaudiana, Synechococcus, Synechocystis, Triticum aestivum* and *Zea mays*.

Even more preferred nucleic acid sequences are encoding transit peptides as disclosed by von Heijne et al. (Plant Molecular Biology Reporter, 9 (2), 104, (1991)), which are hereby incorparated by reference. Table V shows some examples of the transit peptide sequences disclosed by von Heijne et al. According to the disclosure of the invention especially in the examples the skilled worker is able to link other nucleic acid sequences disclosed by von Heijne et al. to the nucleic acid sequences shown in table I, application no. 1, columns 5 and 7. Most preferred nucleic acid sequences encoding transit peptides are derived from the genus *Spinacia* such as chlorplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easely isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions post-translationally to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfer with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small structural flexible amino acids such as glycine or alanine.

As mentioned above the nucleic acid sequences coding for the proteins as shown in table II, application no. 1, column 3 and its homologs as disclosed in table I, application no. 1, columns 5 and 7 can be joined to a nucleic acid sequence encoding a transit peptide. This nucleic acid sequence encoding a transit peptide ensures transport of the protein to the respective organelle, especially the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, application no. 1, column 3 and its homologs as disclosed in table I, application no. 1, columns 5 and 7.

The term "organelle" according to the invention shall mean for example "mitochondria" or preferably "plastid" (throughout the specification the "plural" shall comprise the "singular" and vice versa). The term "plastid" according to the invention is intended to include various forms of plastids including proplastids, chloroplasts, chromoplasts, gerontoplasts, leucoplasts, amyloplasts, elaioplasts and etioplasts, preferably chloroplasts. They all have as a common ancestor the aforementioned proplasts.

Other transit peptides are disclosed by Schmidt et al. (J. Biol. Chem. 268 (36), 27447 (1993)), Della-Cioppa et al. (Plant. Physiol. 84, 965 (1987)), de Castro Silva Filho et al. (Plant Mol. Biol. 30, 769 (1996)), Zhao et al. (J. Biol. Chem. 270 (11), 6081 (1995)), Römer et al. (Biochem. Biophys. Res. Commun. 196 (3), 1414 (1993)), Keegstra et al. (Annu. Rev. Plant Physiol. Plant Mol. Biol. 40, 471 (1989)), Lubben et al. (Photosynthesis Res. 17, 173 (1988)) and Lawrence et al. (J. Biol. Chem. 272 (33), 20357 (1997)). A general review about targeting is disclosed by Kermode Allison R. in Critical Reviews in Plant Science 15 (4), 285 (1996) under the title "Mechanisms of Intracellular Protein Transport and Targeting in Plant Cells."

Favored transit peptide sequences, which are used in the inventive process and which form part of the inventive nucleic acid sequences are generally enriched in hydroxylated amino acid residues (serine and threonine), with these two residues generally constituting 20 to 35% of the total. They often have an amino-terminal region empty of Gly, Pro, and charged residues. Furthermore they have a number of small hydrophobic amino acids such as valine and alanine and generally acidic amino acids are lacking. In addition they generally have a middle region rich in Ser, Thr, Lys and Arg. Overall they have very often a net positive charge.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, golgi complex, glyoxysomes, peroxisomes or mitochondria may be also part of the inventive nucleic acid sequence. The proteins translated from said inventive nucleic acid sequences are a kind of fusion proteins that means the nucleic acid sequences encoding the transit peptide for example the ones shown in table V, preferably the last one of the table are joint to the nucleic acid sequences shown in table I, application no. 1, columns 5 and 7. The person skilled in the art is able to join said sequences in a functional manner. Advantageously the transit peptide part is cleaved off from the protein part shown in table II, application no. 1, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein mentioned in table II, application no. 1, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein motioned in table II, application no. 1, columns 5 and 7. In case of the amino acid sequence QIA CSS the three amino acids in front of the start methionine are stemming from the LIC (=ligatation independent cloning) cassette. Said short amino acid sequence is preferred in the case of the expression of *E. coli* genes. In case of the amino acid sequence QIA EFQLTT the six amino acids in front of the start methionine are stemming from the LIC cassette. Said short amino acid sequence is preferred in the case of the expression of *S. cerevisiae* genes. The skilled worker knows that other short sequences are also useful in the expression of the genes mentioned in table I, application no. 1, columns 5 and 7. Furthermore the skilled worker is aware of the fact that there is not a need for such short sequences in the expression of the genes.

TABLE V

Examples of transit peptides disclosed by von Heijne et al.

| Trans Pep | Organism | Transit Peptide | SEQ ID NO: | Reference |
|---|---|---|---|---|
| 1 | Acetabularia mediterranea | MASIMMNKSVVLSKECAKPLATPKVTLNKRGFATT IATKNREMMVWQPFNNKMFETFSFLPP | 17 | Mol. Gen. Genet. 218, 445 (1989) |
| 2 | Arabidopsis thaliana | MAASLQSTATFLQSAKIATAPSRGSSHLRSTQAVG KSFGLETSSARLTCSFQSDFKDFTGKCSDAVKIAG FALATSALVVSGASAEGAPK | 18 | EMBO J. 8, 3187 (1989) |
| 3 | Arabidopsis thaliana | MAQVSRICNGVQNPSLICNLSKSSQRKSPLSVSLK TQQHPRAYPISSSWGLKKSGMTLIGSELRPLKVMS SVSTAEKASEIVLQPIREISGLIKLP | 19 | Mol. Gen. Genet. 210, 437 (1987) |
| 4 | Arabidopsis thaliana | MAAATTTTTSSSISFSTKPSPSSSKSPLPISRFSL PFSLNPNKSSSSSRRRGIKSSSPSSISAVLNTTTVN TTTPSPTKPTKPETFISRFAPDQPRKGA | 20 | Plant Physiol. 85, 1110 (1987) |
| 5 | Arabidopsis thaliana | MITSSLTCSLQALKLSSPFAHGSTPLSSLSKPNSFP NHRMPALVPV | 21 | J. Biol. Chem. 265, 2763 (1990) |
| 6 | Arabidopsis thaliana | MASLLGTSSSAI-WASPSLSSPSSKPSSSPICFRPG KLFGSKLNAGQIQFPKKNRSRYHVSVMNVATEINST EQVVGKFDSKKSARPVYPFAAI | 22 | EMBO J. 9, 1337 (1990) |
| 7 | Arabidopsis thaliana | MASTALSSAIVGTSFIRRSPAPISLRSLPSANTQSL FGLKSGTARGGRVVAM | 23 | Plant Physiol. 93, 572 (1990) |
| 8 | Arabidopsis thaliana | MAASTMALSSPAFAGKAVNLSPAASEVLGSGRVTNR KTV | 24 | Nucl. Acids Res. 14, 4051 (1986) |
| 9 | Arabidopsis thaliana | MAAITSATVTIPSFTGLKLAVSSKPKTLSTISRSSS ATRAPPKLALKSSLKDFGVIAVATAASIVLAGNAMA MEVLLGSDDGSLAFVPSEFT | 25 | Gene 65, 59 (1988) |
| 10 | Arabidopsis thaliana | MAAAVSTVGAINRAPLSLNGSGSGAVSAPASTFLGK KVVTVSRFAQSNKKSNGSFKVLAVKEDKQTDGDRWR GLAYDTSDDQIDI | 26 | Nucl. Acids Res. 17, 2871 (1989) |
| 11 | Arabidopsis thaliana | MKSSMLSSTAWTSPAQATMVAPFTGLKSSASFPVTR KANNDITSITSNGGRVSC | 27 | Plant Mol. Biol. 11, 745 (1988) |
| 12 | Arabidopsis thaliana | MAASGTSATFRASVSSAPSSSSQLTHLKSPFKAVKYT PLPSSRSKSSSFSVSCTIAKDPPVLMAAGSDPALWQR PDSFGRFGKFGGKYVPE | 28 | Proc. Natl. Acad. Sci. USA, 86, 4604 (1989) |
| 13 | Brassica campestris | MSTTFCSSVCMQATSLAATTRISFQKPLAVSTTNLSFN LRRSIPTRFSISCAAKPETVEKVSKIVKKQLSLKDDQK VVAE | 29 | Nucl. Acids Res. 15, 7197 (1987) |
| 14 | Brassica napus | MATTFSASVSMQATSLATTTRISFQKPVLVSNHGRTNL SFNLSRTRLSISC | 30 | Eur. J. Biochem. 174, 287 (1988) |
| 15 | Chlamydomonas reinhardtii | MQALSSRVNIAAKPQRAQRLVVRAEEVKAAPKKEVGPK RGSLVK | 31 | Plant Mol. Biol. 12, 463 (1989) |
| 16 | Cucurbita moschata | MAELIQDKESAQSAATAAAASSGYERRNEPAHSRKFLE VRSEEELL-SCIKK | 32 | FEBS Lett. 238, 424 (1988) |
| 17 | Spinacea oleracea | MSTINGCLTSISPSRTQLKNTSTLRPTFIANSRVNPSS SVPPSLIRNQPVFAAPAPIITPTL | 33 | J. Biol Chem. 265, (10) 5414 (1990) |
| 18 | Spinacea oleracea | MTTAVTAAVSFPSTKTTSLSARCSSVISPDKISYKKVP LYYRNVSATGKMGPIRAQIASDVEAPPPAPAK-VEKMS | 34 | Curr. Genet. 13, 517 (1988) |

TABLE V-continued

Examples of transit peptides disclosed by von Heijne et al.

| Trans Pep | Organism | Transit Peptide | SEQ ID NO: | Reference |
|---|---|---|---|---|
| 19 | *Spinacea oleracea* | MTTAVTAAVSFPSTKTTSLSARSSSVISPDKISYKKVPLYYRNVSATGKMGPIRA | 35 | |

Alternatively to the targeting of the sequences shown in table II, application no. 1, columns 5 and 7, preferably of sequences in general encoded in the nucleus with the aid of the targeting sequences mentioned for example in table V alone or in combination with other targeting sequences preferably into the plastids, the nucleic acids of the invention can directly be introduced into the plastidal genome. Therefore in a preferred embodiment the nucleic acid sequences shown in table I, application no. 1, columns 5 and 7 are directly introduced and expressed in plastids.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain unintegrated (e.g., by including a chloroplast origin of replication). "Stably" integrated DNA sequences are those, which are inherited through plastid replication, thereby transferring new plastids, with the features of the integrated DNA sequence to the progeny.

For expression a person skilled in the art is familiar with different methods to introduce the nucleic acid sequences into different organelles such as the preferred plastids. Such methods are for example disclosed by Maiga P. (Annu. Rev. Plant Biol. 55, 289 (2004)), Evans T. (WO 2004/040973), McBride K. E. et al. (U.S. Pat. No. 5,455,818), Daniell H. et al. (U.S. Pat. No. 5,932,479 and U.S. Pat. No. 5,693,507) and Straub J. M. et al. (U.S. Pat. No. 6,781,033). A preferred method is the transformation of microspore-derived hypocotyl or cotyledonary tissue (which are green and thus contain numerous plastids) leaf tissue and afterwards the regeneration of shoots from said transformed plant material on selective medium. As methods for the transformation bombarding of the plant material or the use of independently replicating shuttle vectors are well known by the skilled worker. But also a PEG-mediated transformation of the plastids or *Agrobacterium* transformation with binary vectors is possible. Useful markers for the transformation of plastids are positive selection markers for example the chloramphenicol-, streptomycin, kanamycin-, neomycin-, amikamycin-, spectinomycin-, triazine- and/or lincomycin-resistance genes. As additional markers named in the literature often as secondary markers, genes coding for the resistance against herbicides such as phosphinothricin (=glufosinate, BASTA™, Liberty™, encoded by the bar gene), glyphosate (=N-(phosphonomethyl)glycine, Roundup™, encoded by the 5-enolpyruvylshikimate-3-phosphate synthase gene=epsps), sulfonylureas (like Staple™, encoded by the acetolactate synthase (ALS) gene), imidazolinones [=IMI, like imazethapyr, imazamox, Clearfield™, encoded by the acetohydroxyacid synthase (AHAS) gene, also known as acetolactate synthase (ALS) gene] or bromoxynil (=Buctril™, encoded by the oxy gene) or genes coding for antibiotics such as hygromycin or G418 are useful for further selection. Such secondary markers are useful in the case when most genome copies are transformed. In addition negative selection markers such as the bacterial cytosine deaminase (encoded by the codA gene) are also useful for the transformation of plastids.

To increase the possibility of identification of transformants it is also desirable to use reporter genes other then the aforementioned resistance genes or in addition to said genes. Reporter genes are for example β-galactosidase-, β-glucuronidase-(GUS), alkaline phosphatase- and/or green-fluorescent protein-genes (GFP).

For the inventive process it is of great advantage that by transforming the plastids the intraspecies specific transgene flow is blocked, because a lot of species such as corn, cotton and rice have a strict maternal inheritance of plastids. By placing the genes specified in table I, application no. 1, columns 5 and 7 or active fragments thereof in the plastids of plants, these genes will not be present in the pollen of said plants.

A further preferred embodiment of the invention relates to the use of so called "chloroplast localization sequences", in which a first RNA sequence or molecule is capable of transporting or "chaperoning" a second RNA sequence, such as a RNA sequence transcribed from the sequences depicted in table 1, application no. 1, columns 5 and 7 or a sequence encoding a protein, as depicted in table II, application no. 1, columns 5 and 7, from an external environment inside a cell or outside a plastid into a chloroplast. In one embodiment the chloroplast localization signal is substantially similar or complementary to a complete or intact viroid sequence. The chloroplast localization signal may be encoded by a DNA sequence, which is transcribed into the chloroplast localization RNA. The term "viroid" refers to a naturally occurring single stranded RNA molecule (Flores, C. R. Acad Sci III. 324 (10), 943 (2001)). Viroids usually contain about 200-500 nucleotides and generally exist as circular molecules. Examples of viroids that contain chloroplast localization signals include but are not limited to ASBVd, PLMVd, CChMVd and ELVd. The viroid sequence or a functional part of it can be fused to the sequences depicted in table I, application no. 1, columns 5 and 7 or a sequence encoding a protein, as depicted in table II, application no. 1, columns 5 and 7 in such a manner that the viroid sequence transports a sequence transcribed from a sequence as depicted in table 1, application no. 1, columns 5 and 7 or a sequence encoding a protein as depicted in table II, application no. 1, columns 5 and 7 into the chloroplasts. A preferred embodiment uses a modified ASBVd (Navarro et al., Virology. 268 (1), 218 (2000)).

In a further specific embodiment the protein to be expressed in the plastids such as the proteins depicted in table II, application no. 1, columns 5 and 7 are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence.

The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, columns 5 and 7.

In a preferred embodiment of the invention the nucleic acid sequences as shown in table I, application no. 1, columns 5 and 7 used in the inventive process are transformed into plastids, which are metabolically active. Those plastids should preferably maintain at a high copy number in the plant or plant tissue of interest, most preferably the chloroplasts found in green plant tissues, such as leaves or cotyledons or in seeds.

For a good expression in the plastids the nucleic acid sequences as shown in table I, application no. 1, columns 5 and 7 are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

For the purposes of the description of the present invention, the terms "cytoplasmic" shall indicate, that the nucleic acid of the invention is expressed without the addition of an non-natural transit peptide encoding sequence. A non-natural transit peptide encoding sequence is a sequence which is not a natural part of a nucleic acid of the invention, e.g. of the nucleic acids depicted in table I column 5 or 7, but is rather added by molecular manipulation steps as for example described in the example under "plastid targeted expression". Therfore the terms "cytoplasmic" shall not exclude a targeted localisation to any cell compartment for the products of the inventive nucleic acid sequences by their naturally occurring sequence properties within the background of the transgenic organism. The subcellular location of the mature polypeptide derived from the enclosed sequences can be predicted by a skilled person for the organism (plant) by using software tools like TargetP (Emanuelsson et al., (2000), Predicting subcellular localization of proteins based on their N-terminal amino acid sequence., J. Mol. Biol. 300, 1005-1016.), ChloroP (Emanuelsson et al. (1999), ChloroP, a neural networkbased method for predicting chloroplast transit peptides and their cleavage sites., Protein Science, 8: 978-984.) or other predictive software tools (Emanuelsson et al. (2007), Locating proteins in the cell using TargetP, SignalP, and related tools., Nature Protocols 2, 953-971).

Comprises/comprising and grammatical variations thereof when used in this specification are to be taken to specify the presence of stated features, integers, steps or components or groups thereof, but not to preclude the presence or addition of one or more other features, integers, steps, components or groups thereof.

In accordance with the invention, the term "plant cell" or the term "organism" as understood herein relates always to a plant cell or an organelle thereof, preferably a plastid, more preferably chloroplast.

As used herein, "plant" is meant to include not only a whole plant but also a part thereof i.e., one or more cells, and tissues, including for example, leaves, stems, shoots, roots, flowers, fruits and seeds.

Surprisingly it was found, that the transgenic expression of a protein as shown in table II, application no. 1, column 3, especially from the *Saccaromyces cerevisiae* and/or the transgenic expression of a protein as shown in table II, application no. 1, column 3, especially from the *E. coli*, in a plant, such as *Arabidopsis thaliana* for example, conferred a yield increase, especially an enhanced NUE and/or increased biomass production, to the transgenic plant cell, plant or a part thereof as compared to a corresponding non-transformed wild type plant cell, a plant or a part thereof. In addition the yield increase may be generated by an increased tolerance to stress, especially abiotic stress, particularly low temperature stress and/or enhanced water use efficiency and/or enhanced intrinsic yield in the absence of nutrient deficiencies as well as stress conditions.

Accordingly, in one embodiment, in case the *Escherichia coli* nucleic acid molecule SEQ ID NO. 38, or a nucleic acid which differs from nucleic acid SEQ ID NO. 38 by exchanging the stop codon taa by tga, or the activity of a polypeptide encoded by a nucleic acid molecule comprising the nucleic acid SEQ ID NO. 38 (or a nucleic acid which differs from nucleic acid SEQ ID NO. 38 by exchanging the stop codon taa by tga) or a polypeptide SEQ ID NO. 39, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 38 or polypeptide SEQ ID NO. 39, respectively, is increased or generated, or if the activity "b0017-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 42, or the activity of a polypeptide encoded by a nucleic acid molecule comprising the nucleic acid SEQ ID NO. 42 or a polypeptide SEQ ID NO. 43, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 42 or polypeptide SEQ ID NO. 43, respectively, is increased or generated, or if the activity "transport protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.15-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 123, or a nucleic acid which differs from nucleic acid SEQ ID NO. 123 by exchanging the stop codon taa by tga, or the activity of a polypeptide encoded by a nucleic acid molecule comprising the nucleic acid SEQ ID NO. 123 (or a nucleic acid which differs from nucleic acid SEQ ID NO. 123 by exchanging the stop codon taa by tga) or a polypeptide SEQ ID NO. 124, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 123 or polypeptide SEQ ID NO. 124, respectively, is increased or generated, or if the activity "hydroxymyristol acyl carrier protein dehydratase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.41-fold plus at least 100% thereof under conditions of nitrogen deficiency is conferred; also particularly, an increase from 1.05-fold to 1.33-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* K12 nucleic acid molecule SEQ ID NO. 380, or the activity of a polypeptide encoded by a nucleic acid molecule comprising the nucleic acid SEQ ID NO. 380 or a polypeptide SEQ ID NO. 381, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 380 or polypeptide SEQ ID NO. 381, respectively, is increased or generated, or if the activity "gamma-glutamyl kinase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.16-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 679, or the activity of a polypeptide encoded by a nucleic acid molecule comprising the nucleic acid SEQ ID NO. 679 or a polypeptide SEQ ID NO. 680, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 679 or polypeptide SEQ ID NO. 680, respectively, is increased or generated, or if the activity "alpha-glucosidase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.10-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 812, or the activity of a polypeptide encoded by a nucleic acid molecule comprising the nucleic acid SEQ ID NO. 812 or a polypeptide SEQ ID NO. 813, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 812 or polypeptide SEQ ID NO. 813, respectively, is increased or generated, or if the activity "adenylate kinase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.24-fold plus at least 100% thereof under conditions of nitrogen deficiency is conferred; also particularly, an increase from 1.05-fold to 1.09-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 1055, or the activity of a polypeptide encoded by a nucleic acid molecule comprising the nucleic acid SEQ ID NO. 1055 or a polypeptide SEQ ID NO. 1056, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 1055 or polypeptide SEQ ID NO. 1056, respectively, is increased or generated, or if the activity "2-dehydro-3-deoxy-phosphoheptonate aldolase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.15-fold plus at least 100% thereof under conditions of nitrogen deficiency is conferred; also particularly, an increase from 1.05-fold to 1.23-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 1563, or the activity of a polypeptide encoded by a nucleic acid molecule comprising the nucleic acid SEQ ID NO. 1563 or a polypeptide SEQ ID NO. 1564, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 1563 or polypeptide SEQ ID NO. 1564, respectively, is increased or generated, or if the activity "molybdopterin biosynthesis protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.20-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 1705, or the activity of a polypeptide encoded by a nucleic acid molecule comprising the nucleic acid SEQ ID NO. 1705 or a polypeptide SEQ ID NO. 1706, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 1705 or polypeptide SEQ ID NO. 1706, respectively, is increased or generated, or if the activity "hydroxylamine reductase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.17-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 1844, or the activity of a polypeptide encoded by a nucleic acid molecule comprising the nucleic acid SEQ ID NO. 1844 or a polypeptide SEQ ID NO. 1845, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 1844 or polypeptide SEQ ID NO. 1845, respectively, is increased or generated, or if the activity "proline dehydrogenase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 1950, or the activity of a polypeptide encoded by a nucleic acid molecule comprising the nucleic acid SEQ ID NO. 1950 or a polypeptide SEQ ID NO. 1951, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 1950 or polypeptide SEQ ID NO. 1951, respectively, is increased or generated, or if the activity "PhoH-like protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.10-fold plus at least 100% thereof under conditions of nitrogen deficiency is conferred; also particularly, an increase from 1.05-fold to 1.17-fold plus at least 100% thereof under low temperature conditions; as compared to a corresponding non-transformed wild type plant cell, a plant or a part thereof.

Accordingly, in one embodiment, in case the *Escherichia coli* nucleic acid molecule SEQ ID NO. 1975, or the activity of a polypeptide encoded by a nucleic acid molecule comprising the nucleic acid SEQ ID NO. 1975 or a polypeptide SEQ ID NO. 1976, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 1975 or polypeptide SEQ ID NO. 1976, respectively, is increased or generated, or if the activity "isomerase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.23-fold plus at least 100% thereof under conditions of nitrogen deficiency is conferred; also particularly, an increase from 1.05-fold to 1.18-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 2127, or a nucleic acid which differs from nucleic acid SEQ ID NO. 2127 by exchanging the stop codon taa by tga, or the activity of a polypeptide encoded by a nucleic acid molecule comprising the nucleic acid SEQ ID NO. 2127 (or a nucleic acid which differs from nucleic acid SEQ ID NO. 2127 by exchanging the stop codon taa by tga) or a polypeptide SEQ ID NO. 2128, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2127 or polypeptide SEQ ID NO. 2128, respectively, is increased or generated, or if the activity "b1933-protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.55-fold plus at least 100% thereof under conditions of nitrogen deficiency is conferred; also particularly, an increase from 1.05-fold to 1.12-fold plus at least 100% thereof under low temperature conditions; as compared to a corresponding non-transformed wild type plant cell, a plant or a part thereof. Accordingly, in one embodiment, in case the *Escherichia coli* nucleic acid molecule SEQ ID NO. 2135, or a nucleic acid which differs from nucleic acid SEQ ID NO. 2135 by exchanging the stop codon taa by tga, or the activity of a polypeptide encoded by a nucleic acid molecule comprising the nucleic acid SEQ ID NO. 2135 (or a nucleic acid which differs from nucleic acid SEQ ID NO. 2135 by exchanging the stop codon taa by tga) or a polypeptide SEQ ID NO. 2136, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2135 or polypeptide SEQ ID NO. 2136, respectively, is increased or generated, or if the activity "glycosyltransferase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.24-fold plus at least 100% thereof under conditions of nitrogen deficiency is conferred; also particularly, an increase from 1.05-fold to 1.14-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* K12 nucleic acid molecule SEQ ID NO. 2171, or the activity of a polypeptide encoded by a nucleic acid molecule comprising the nucleic acid SEQ ID NO. 2171 or a polypeptide SEQ ID NO. 2172, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2171 or polypeptide SEQ ID NO. 2172, respectively, is increased or generated, or if the activity "b2165-protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.24-fold plus at least 100% thereof under conditions of nitrogen deficiency is conferred; also particularly, an increase from 1.05-fold to 1.24-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* K12 nucleic acid molecule SEQ ID NO. 2297, or a nucleic acid which differs from nucleic acid SEQ ID NO. 2297 by exchanging the stop codon taa by tga, or the activity of a polypeptide encoded by a nucleic acid molecule comprising the nucleic acid SEQ ID NO. 2297 (or a nucleic acid which differs from nucleic acid SEQ ID NO. 2297 by exchanging the stop codon taa by tga) or a polypeptide SEQ ID NO. 2298, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2297 or polypeptide SEQ ID NO. 2298, respectively, is increased or generated, or if the activity "short chain fatty acid transporter" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.36-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 2426, or a nucleic acid which differs from nucleic acid SEQ ID NO. 2426 by exchanging the stop codon taa by tga, or the activity of a polypeptide encoded by a nucleic acid molecule comprising the nucleic acid SEQ ID NO. 2426 (or a nucleic acid which differs from nucleic acid SEQ ID NO. 2426 by exchanging the stop codon taa by tga) or a polypeptide SEQ ID NO. 2427, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2426 or polypeptide SEQ ID NO. 2427, respectively, is increased or generated, or if the activity "b2238-protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance, especially an increased tolerance to low temperatures, and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.26-fold plus at least 100% thereof under conditions of nitrogen deficiency is conferred; also particularly, an increase from 1.05-fold to 1.19-fold plus at least 100% thereof under low temperature conditions; also particularly, an increase from 1.05-fold to 1.18-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 2426, or a nucleic acid which differs from nucleic acid SEQ ID NO. 2426 by exchanging the stop codon taa by tga, or the activity of a polypeptide encoded by a nucleic acid molecule comprising the nucleic acid SEQ ID NO. 2426 (or a nucleic acid which differs from nucleic acid SEQ ID NO. 2426 by exchanging the stop codon taa by tga) or a polypeptide SEQ ID NO. 2427, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2426 or polypeptide SEQ ID NO. 2427, respectively, is increased or generated, or if the activity "b2238-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance, especially an increased tolerance to drought conditions, and/or an increased yield, in the absence of a nutrient deficiency as well as stress conditions.

Particularly, an increase from 1.05-fold to 1.11-fold plus at least 100% thereof under drought conditions is conferred; also particularly, as compared to a corresponding non-transformed wild type plant cell, a plant or a part thereof.

Accordingly, in one embodiment, in case the *Escherichia coli* K12 nucleic acid molecule SEQ ID NO. 2452, or a nucleic acid which differs from nucleic acid SEQ ID NO. 2452 by exchanging the stop codon taa by tga, or the activity of a polypeptide encoded by a nucleic acid molecule comprising the nucleic acid SEQ ID NO. 2452 (or a nucleic acid which differs from nucleic acid SEQ ID NO. 2452 by exchanging the stop codon taa by tga) or a polypeptide SEQ ID NO. 2453, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2452 or polypeptide SEQ ID NO. 2453, respectively, is increased or generated, or if the activity "lysine/arginine/ornithine transporter subunit" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.18-fold plus at least 100% thereof under conditions of nitrogen deficiency is conferred; also particularly, an increase from 1.05-fold to 1.25-fold plus at least 100% thereof under low temperature conditions; also particularly, an increase from 1.05-fold to 1.20-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 2551, or the activity of a polypeptide encoded by a nucleic acid molecule comprising the nucleic acid SEQ ID NO. 2551 or a polypeptide SEQ ID NO. 2552, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2551 or polypeptide SEQ ID NO. 2552, respectively, is increased or generated, or if the activity "b2431-protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.47-fold plus at least 100% thereof under conditions of nitrogen deficiency is conferred; also particularly, an increase from 1.05-fold to 1.34-fold plus at least 100% thereof under low temperature conditions; also particularly, an increase from 1.05-fold to 1.17-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* K12 nucleic acid molecule SEQ ID NO. 2600, or the activity of a polypeptide encoded by a nucleic acid molecule comprising the nucleic acid SEQ ID NO. 2600 or a polypeptide SEQ ID NO. 2601, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2600 or polypeptide SEQ ID NO. 2601, respectively, is increased or generated, or if the activity "chorismate mutase T/prephenate dehydrogenase (bifunctional)" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.12-fold plus at least 100% thereof under conditions of nitrogen deficiency is conferred; also particularly, an increase from 1.05-fold to 1.16-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 2668, or the activity of a polypeptide encoded by a nucleic acid molecule comprising the nucleic acid SEQ ID NO. 2668 or a polypeptide SEQ ID NO. 2669, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2668 or polypeptide SEQ ID NO. 2669, respectively, is increased or generated, or if the activity "b2766-protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.10-fold plus at least 100% thereof under conditions of nitrogen deficiency is conferred; also particularly, an increase from 1.05-fold to 1.26-fold plus at least 100% thereof under low temperature conditions; also particularly, an increase from 1.05-fold to 1.20-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 2772, or the activity of a polypeptide encoded by a nucleic acid molecule comprising the nucleic acid SEQ ID NO. 2772 or a polypeptide SEQ ID NO. 2773, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 2772 or polypeptide SEQ ID NO. 2773, respectively, is increased or generated, or if the activity "glycine decarboxylase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.65-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 3117, or the activity of a polypeptide encoded by a nucleic acid molecule comprising the nucleic acid SEQ ID NO. 3117 or a polypeptide SEQ ID NO. 3118, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 3117 or polypeptide SEQ ID NO. 3118, respectively, is increased or generated, or if the activity "threonine ammonia-lyase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.42-fold plus at least 100% thereof under conditions of nitrogen deficiency is conferred; also particularly, an increase from 1.05-fold to 1.16-fold plus at least 100% thereof under low temperature conditions; as compared to a corresponding non-transformed wild type plant cell, a plant or a part thereof. Accordingly, in one embodiment, in case the *Escherichia coli* nucleic acid molecule SEQ ID NO. 3390, or a nucleic acid which differs from nucleic acid SEQ ID NO. 3390 by exchanging the stop codon taa by tga, or the activity of a polypeptide encoded by a nucleic acid molecule comprising the nucleic acid SEQ ID NO. 3390 (or a nucleic acid which differs from nucleic acid SEQ ID NO. 3390 by exchanging the stop codon taa by tga) or a polypeptide SEQ ID NO. 3391, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 3390 or polypeptide SEQ ID NO. 3391, respectively, is increased or generated, or if the activity "b3120-protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.28-fold plus at least 100% thereof under conditions of nitrogen deficiency is conferred; also particularly, an increase from 1.05-fold to 1.15-fold plus at least 100% thereof under low temperature conditions; also particularly, an increase from 1.05-fold to 1.39-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 3396, or the activity of a polypeptide encoded by a nucleic acid molecule comprising the nucleic acid SEQ ID NO. 3396 or a polypeptide SEQ ID NO. 3397, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 3396 or polypeptide SEQ ID NO. 3397, respectively, is increased or generated, or if the activity "outer membrane usher protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred; as compared to a corresponding non-transformed wild type plant cell, a plant or a part thereof.

Accordingly, in one embodiment, in case the *Escherichia coli* K12 nucleic acid molecule SEQ ID NO. 3470, or the activity of a polypeptide encoded by a nucleic acid molecule comprising the nucleic acid SEQ ID NO. 3470 or a polypeptide SEQ ID NO. 3471, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 3470 or polypeptide SEQ ID NO. 3471, respectively, is increased or generated, or if the activity "glycerol-3-phosphate transporter subunit" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred; also particularly, an increase from 1.05-fold to 1.10-fold plus at least 100% thereof under low temperature conditions; also particularly, an increase from 1.05-fold to 1.23-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 3563, or a nucleic acid which differs from nucleic acid SEQ ID NO. 3563 by exchanging the stop codon taa by tga, or the activity of a polypeptide encoded by a nucleic acid molecule comprising the nucleic acid SEQ ID NO. 3563 (or a nucleic acid which differs from nucleic acid SEQ ID NO. 3563 by exchanging the stop codon taa by tga) or a polypeptide SEQ ID NO. 3564, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 3563 or polypeptide SEQ ID NO. 3564, respectively, is increased or generated, or if the activity "hydro-lyase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.25-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 3770, or the activity of a polypeptide encoded by a nucleic acid molecule comprising the nucleic acid SEQ ID NO. 3770 or a polypeptide SEQ ID NO. 3771, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 3770 or polypeptide SEQ ID NO. 3771, respectively, is increased or generated, or if the activity "lysophospholipase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.42-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 3868, or the activity of a polypeptide encoded by a nucleic acid molecule comprising the nucleic acid SEQ ID NO. 3868 or a polypeptide SEQ ID NO. 3869, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 3868 or polypeptide SEQ ID NO. 3869, respectively, is increased or generated, or if the activity "yal019w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.42-fold plus at least 100% thereof under conditions of nitrogen deficiency is conferred; also particularly, an increase from 1.05-fold to 1.14-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 3895, or the activity of a polypeptide encoded by a nucleic acid molecule comprising the nucleic acid SEQ ID NO. 3895 or a polypeptide SEQ ID NO. 3896, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 3895 or polypeptide SEQ ID NO. 3896, respectively, is increased or generated, or if the activity "carnitine acetyltransferase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.38-fold plus at least 100% thereof under conditions of nitrogen deficiency is conferred; also particularly, an increase from 1.05-fold to 1.43-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 3953, or the activity of a polypeptide encoded by a nucleic acid molecule comprising the nucleic acid SEQ ID NO. 3953 or a polypeptide SEQ ID NO. 3954, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 3953 or polypeptide SEQ ID NO. 3954, respectively, is increased or generated, or if the activity "Transcriptional activator" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.15-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 4111, or the activity of a polypeptide encoded by a nucleic acid molecule comprising the nucleic acid SEQ ID NO. 4111 or a polypeptide SEQ ID NO. 4112, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4111 or polypeptide SEQ ID NO. 4112, respectively, is increased or generated, or if the activity "splicing factor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.10-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 4149, or the activity of a polypeptide encoded by a nucleic acid molecule comprising the nucleic acid SEQ ID NO. 4149 or a polypeptide SEQ ID NO. 4150, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4149 or polypeptide SEQ ID NO. 4150, respectively, is increased or generated, or if the activity "autophagy-specific phosphatidylinositol 3-kinase complex protein subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 4162, or the activity of a polypeptide encoded by a nucleic acid molecule comprising the nucleic acid SEQ ID NO. 4162 or a polypeptide SEQ ID NO. 4163, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4162 or polypeptide SEQ ID NO. 4163, respectively, is increased or generated, or if the activity "microsomal beta-keto-reductase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.23-fold plus at least 100% thereof under conditions of nitrogen deficiency is conferred; also particularly, an increase from 1.05-fold to 1.07-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 4235, or the activity of a polypeptide encoded by a nucleic acid molecule comprising the nucleic acid SEQ ID NO. 4235 or a polypeptide SEQ ID NO. 4236, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4235 or polypeptide SEQ ID NO. 4236, respectively, is increased or generated, or if the activity "UDP-N-acetyl-glucosamine-1-P transferase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.16-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 4235, or the activity of a polypeptide encoded by a nucleic acid molecule comprising the nucleic acid SEQ ID NO. 4235 or a polypeptide SEQ ID NO. 4236, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4235 or polypeptide SEQ ID NO. 4236, respectively, is increased or generated, or if the activity "UDP-N-acetyl-glucosamine-1-P transferase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions.

Particularly, an increase from 1.05-fold to 1.26-fold plus at least 100% thereof under low temperature conditions; also particularly, an increase from 1.05-fold to 1.29-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 4280, or the activity of a polypeptide encoded by a nucleic acid molecule comprising the nucleic acid SEQ ID NO. 4280 or a polypeptide SEQ ID NO. 4281, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4280 or polypeptide SEQ ID NO. 4281, respectively, is increased or generated, or if the activity "ybr262c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.31-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 4288, or the activity of a polypeptide encoded by a nucleic acid molecule comprising the nucleic acid SEQ ID NO. 4288 or a polypeptide SEQ ID NO. 4289, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4288 or polypeptide SEQ ID NO. 4289, respectively, is increased or generated, or if the activity "protein necessary for structural stability of L-A double-stranded RNA-containing particles" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.31-fold plus at least 100% thereof under conditions of nitrogen deficiency is conferred; also particularly, an increase from 1.05-fold to 1.24-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 4315, or the activity of a polypeptide encoded by a nucleic acid molecule comprising the nucleic acid SEQ ID NO. 4315 or a polypeptide SEQ ID NO. 4316, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4315 or polypeptide SEQ ID NO. 4316, respectively, is increased or generated, or if the activity "YDR070C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.20-fold plus at least 100% thereof under conditions of nitrogen deficiency is conferred; also particularly, an increase from 1.05-fold to 1.47-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 4325, or the activity of a polypeptide encoded by a nucleic acid molecule comprising the nucleic acid SEQ ID NO. 4325 or a polypeptide SEQ ID NO. 4326, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4325 or polypeptide SEQ ID NO. 4326, respectively, is increased or generated, or if the activity "chaperone" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.29-fold plus at least 100% thereof under conditions of nitrogen deficiency is conferred; also particularly, an increase from 1.05-fold to 1.09-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 4335, or the activity of a polypeptide encoded by a nucleic acid molecule comprising the nucleic acid SEQ ID NO. 4335 or a polypeptide SEQ ID NO. 4336, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4335 or polypeptide SEQ ID NO. 4336, respectively, is increased or generated, or if the activity "helix-loop-helix transcription activator that binds inositol/choline-responsive elements" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred; as compared to a corresponding non-transformed wild type plant cell, a plant or a part thereof.

Accordingly, in one embodiment, in case the *Saccharomyces cerevisiae* nucleic acid molecule SEQ ID NO. 4346, or the activity of a polypeptide encoded by a nucleic acid molecule comprising the nucleic acid SEQ ID NO. 4346 or a polypeptide SEQ ID NO. 4347, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4346 or polypeptide SEQ ID NO. 4347, respectively, is increased or generated, or if the activity "golgi membrane exchange factor subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.22-fold plus at least 100% thereof under conditions of nitrogen deficiency is conferred; also particularly, an increase from 1.05-fold to 1.14-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 4361, or the activity of a polypeptide encoded by a nucleic acid molecule comprising the nucleic acid SEQ ID NO. 4361 or a polypeptide SEQ ID NO. 4362, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4361 or polypeptide SEQ ID NO. 4362, respectively, is increased or generated, or if the activity "dihydrosphingosine phosphate lyase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.13-fold plus at least 100% thereof under conditions of nitrogen deficiency is conferredas compared to a corresponding non-transformed wild type plant cell, a plant or a part thereof.

Accordingly, in one embodiment, in case the *Saccharomyces cerevisiae* nucleic acid molecule SEQ ID NO. 4361, or the activity of a polypeptide encoded by a nucleic acid molecule comprising the nucleic acid SEQ ID NO. 4361 or a polypeptide SEQ ID NO. 4362, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4361 or polypeptide SEQ ID NO. 4362, respectively, is increased or generated, or if the activity "dihydrosphingosine phosphate lyase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions.

Particularly, an increase from 1.05-fold to 1.35-fold plus at least 100% thereof under drought conditions is conferred as compared to a corresponding non-transformed wild type plant cell, a plant or a part thereof.

Accordingly, in one embodiment, in case the *Saccharomyces cerevisiae* nucleic acid molecule SEQ ID NO. 4402, or the activity of a polypeptide encoded by a nucleic acid molecule comprising the nucleic acid SEQ ID NO. 4402 or a polypeptide SEQ ID NO. 4403, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4402 or polypeptide SEQ ID NO. 4403, respectively, is increased or generated, or if the activity "ubiquitin regulatory protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.38-fold plus at least 100% thereof under conditions of nitrogen deficiency is conferred; also particularly, an increase from 1.05-fold to 1.24-fold plus at least 100% thereof under low temperature conditions; also particularly, an increase from 1.05-fold to 1.14-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 4431, or the activity of a polypeptide encoded by a nucleic acid molecule comprising the nucleic acid SEQ ID NO. 4431 or a polypeptide SEQ ID NO. 4432, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4431 or polypeptide SEQ ID NO. 4432, respectively, is increased or generated, or if the activity "ydr355c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.34-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 4435, or the activity of a polypeptide encoded by a nucleic acid molecule comprising the nucleic acid SEQ ID NO. 4435 or a polypeptide SEQ ID NO. 4436, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4435 or polypeptide SEQ ID NO. 4436, respectively, is increased or generated, or if the activity "lysine-specific metalloprotease" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.16-fold plus at least 100% thereof under conditions of nitrogen deficiency is conferred; also particularly, an increase from 1.05-fold to 1.10-fold plus at least 100% thereof under low temperature conditions; also particularly, an increase from 1.05-fold to 1.61-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 4485, or the activity of a polypeptide encoded by a nucleic acid molecule comprising the nucleic acid SEQ ID NO. 4485 or a polypeptide SEQ ID NO. 4486, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4485 or polypeptide SEQ ID NO. 4486, respectively, is increased or generated, or if the activity "subunit of the transport protein particle (TRAPP) complex of the cis-Golgi" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.20-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 4506, or the activity of a polypeptide encoded by a nucleic acid molecule comprising the nucleic acid SEQ ID NO. 4506 or a polypeptide SEQ ID NO. 4507, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4506 or polypeptide SEQ ID NO. 4507, respectively, is increased or generated, or if the activity "myo-inositol transporter" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.16-fold plus at least 100% thereof under conditions of nitrogen deficiency is conferred; also particularly, an increase from 1.05-fold to 1.23-fold plus at least 100% thereof under low temperature conditions; also particularly, an increase from 1.05-fold to 1.10-fold plus at least 100% thereof under drought conditions; also particularly, an increase from 1.05-fold to 1.14-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 4790, or the activity of a polypeptide encoded by a nucleic acid molecule comprising the nucleic acid SEQ ID NO. 4790 or a polypeptide SEQ ID NO. 4791, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4790 or polypeptide SEQ ID NO. 4791, respectively, is increased or generated, or if the activity "SM complex B protein for mRNA splicing" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.23-fold plus at least 100% thereof under conditions of nitrogen deficiency is conferred; also particularly, an increase from 1.05-fold to 1.13-fold plus at least 100% thereof under low temperature conditions; also particularly, an increase from 1.05-fold to 1.10-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 4806, or the activity of a polypeptide encoded by a nucleic acid molecule comprising the nucleic acid SEQ ID NO. 4806 or a polypeptide SEQ ID NO. 4807, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4806 or polypeptide SEQ ID NO. 4807, respectively, is increased or generated, or if the activity "YFR007W-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.36-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 4836, or the activity of a polypeptide encoded by a nucleic acid molecule comprising the nucleic acid SEQ ID NO. 4836 or a polypeptide SEQ ID NO. 4837, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 4836 or polypeptide SEQ ID NO. 4837, respectively, is increased or generated, or if the activity "oxidoreductase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.22-fold plus at least 100% thereof under conditions of nitrogen deficiency is conferred; also particularly, an increase from 1.05-fold to 1.32-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 5311, or the activity of a polypeptide encoded by a nucleic acid molecule comprising the nucleic acid SEQ ID NO. 5311 or a polypeptide SEQ ID NO. 5312, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5311 or polypeptide SEQ ID NO. 5312, respectively, is increased or generated, or if the activity "transcription elongation factor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.26-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5346, or the activity of a polypeptide encoded by a nucleic acid molecule comprising the nucleic acid SEQ ID NO. 5346 or a polypeptide SEQ ID NO. 5347, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5346 or polypeptide SEQ ID NO. 5347, respectively, is increased or generated, or if the activity "cytosolic catalase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.13-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5533, or the activity of a polypeptide encoded by a nucleic acid molecule comprising the nucleic acid SEQ ID NO. 5533 or a polypeptide SEQ ID NO. 5534, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5533 or polypeptide SEQ ID NO. 5534, respectively, is increased or generated, or if the activity "ygr122c-a-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.30-fold plus at least 100% thereof under conditions of nitrogen deficiency is conferred; as compared to a corresponding non-transformed wild type plant cell, a plant or a part thereof.

Accordingly, in one embodiment, in case the *Saccharomyces cerevisiae* nucleic acid molecule SEQ ID NO. 5551, or the activity of a polypeptide encoded by a nucleic acid molecule comprising the nucleic acid SEQ ID NO. 5551 or a polypeptide SEQ ID NO. 5552, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5551 or polypeptide SEQ ID NO. 5552, respectively, is increased or generated, or if the activity "v-SNARE binding protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5559, or the activity of a polypeptide encoded by a nucleic acid molecule comprising the nucleic acid SEQ ID NO. 5559 or a polypeptide SEQ ID NO. 5560, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5559 or polypeptide SEQ ID NO. 5560, respectively, is increased or generated, or if the activity "protein involved in sphingolipid biosynthesis" is increased or generated in an plant cell, plant or part thereof, especially with Cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5602, or the activity of a polypeptide encoded by a nucleic acid molecule comprising the nucleic acid SEQ ID NO. 5602 or a polypeptide SEQ ID NO. 5603, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5602 or polypeptide SEQ ID NO. 5603, respectively, is increased or generated, or if the activity "mitochondrial ribosomal protein of the small subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.23-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5608, or the activity of a polypeptide encoded by a nucleic acid molecule comprising the nucleic acid SEQ ID NO. 5608 or a polypeptide SEQ ID NO. 5609, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5608 or polypeptide SEQ ID NO. 5609, respectively, is increased or generated, or if the activity "phosphatidylserine decarboxylase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.12-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5614, or the activity of a polypeptide encoded by a nucleic acid molecule comprising the nucleic acid SEQ ID NO. 5614 or a polypeptide SEQ ID NO. 5615, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5614 or polypeptide SEQ ID NO. 5615, respectively, is increased or generated, or if the activity "cholinephosphate cytidylyltransferase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.55-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5666, or the activity of a polypeptide encoded by a nucleic acid molecule comprising the nucleic acid SEQ ID NO. 5666 or a polypeptide SEQ ID NO. 5667, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5666 or polypeptide SEQ ID NO. 5667, respectively, is increased or generated, or if the activity "ygr266w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.34-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5701, or the activity of a polypeptide encoded by a nucleic acid molecule comprising the nucleic acid SEQ ID NO. 5701 or a polypeptide SEQ ID NO. 5702, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5701 or polypeptide SEQ ID NO. 5702, respectively, is increased or generated, or if the activity "cell wall endo-beta-1,3-glucanase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5750, or the activity of a polypeptide encoded by a nucleic acid molecule comprising the nucleic acid SEQ ID NO. 5750 or a polypeptide SEQ ID NO. 5751, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5750 or polypeptide SEQ ID NO. 5751, respectively, is increased or generated, or if the activity "ygr290w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5754, or the activity of a polypeptide encoded by a nucleic acid molecule comprising the nucleic acid SEQ ID NO. 5754 or a polypeptide SEQ ID NO. 5755, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5754 or polypeptide SEQ ID NO. 5755, respectively, is increased or generated, or if the activity "yhl021c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred; also particularly, an increase from 1.05-fold to 1.12-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 5778, or the activity of a polypeptide encoded by a nucleic acid molecule comprising the nucleic acid SEQ ID NO. 5778 or a polypeptide SEQ ID NO. 5779, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5778 or polypeptide SEQ ID NO. 5779, respectively, is increased or generated, or if the activity "v-SNARE protein involved in Golgi transport" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5812, or the activity of a polypeptide encoded by a nucleic acid molecule comprising the nucleic acid SEQ ID NO. 5812 or a polypeptide SEQ ID NO. 5813, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5812 or polypeptide SEQ ID NO. 5813, respectively, is increased or generated, or if the activity "mitochondrial seryl-tRNA synthetase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5967, or the activity of a polypeptide encoded by a nucleic acid molecule comprising the nucleic acid SEQ ID NO. 5967 or a polypeptide SEQ ID NO. 5968, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5967 or polypeptide SEQ ID NO. 5968, respectively, is increased or generated, or if the activity "yhr127w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.36-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5973, or the activity of a polypeptide encoded by a nucleic acid molecule comprising the nucleic acid SEQ ID NO. 5973 or a polypeptide SEQ ID NO. 5974, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5973 or polypeptide SEQ ID NO. 5974, respectively, is increased or generated, or if the activity "aromatic amino acid aminotransferase II" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.39-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 5973, or the activity of a polypeptide encoded by a nucleic acid molecule comprising the nucleic acid SEQ ID NO. 5973 or a polypeptide SEQ ID NO. 5974, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 5973 or polypeptide SEQ ID NO. 5974, respectively, is increased or generated, or if the activity "aromatic amino acid aminotransferase II" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.05-fold to 1.13-fold plus at least 100% thereof under low temperature conditions is conferred as compared to a corresponding non-transformed wild type plant cell, a plant or a part thereof.

Accordingly, in one embodiment, in case the *Saccharomyces cerevisiae* nucleic acid molecule SEQ ID NO. 6027, or the activity of a polypeptide encoded by a nucleic acid molecule comprising the nucleic acid SEQ ID NO. 6027 or a polypeptide SEQ ID NO. 6028, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6027 or polypeptide SEQ ID NO. 6028, respectively, is increased or generated, or if the activity "glucoamylase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 3.09-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6027, or the activity of a polypeptide encoded by a nucleic acid molecule comprising the nucleic acid SEQ ID NO. 6027 or a polypeptide SEQ ID NO. 6028, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6027 or polypeptide SEQ ID NO. 6028, respectively, is increased or generated, or if the activity "glucoamylase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.05-fold to 1.20-fold plus at least 100% thereof under low temperature conditions is conferred as compared to a corresponding non-transformed wild type plant cell, a plant or a part thereof.

Accordingly, in one embodiment, in case the *Saccharomyces cerevisiae* nucleic acid molecule SEQ ID NO. 6107, or the activity of a polypeptide encoded by a nucleic acid molecule comprising the nucleic acid SEQ ID NO. 6107 or a polypeptide SEQ ID NO. 6108, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6107 or polypeptide SEQ ID NO. 6108, respectively, is increased or generated, or if the activity "histidine kinase osmosensor that regulates an osmosensing MAP kinase cascade" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6150, or the activity of a polypeptide encoded by a nucleic acid molecule comprising the nucleic acid SEQ ID NO. 6150 or a polypeptide SEQ ID NO. 6151, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6150 or polypeptide SEQ ID NO. 6151, respectively, is increased or generated, or if the activity "saccharopine dehydrogenase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 2.42-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6198, or the activity of a polypeptide encoded by a nucleic acid molecule comprising the nucleic acid SEQ ID NO. 6198 or a polypeptide SEQ ID NO. 6199, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6198 or polypeptide SEQ ID NO. 6199, respectively, is increased or generated, or if the activity "spindle checkpoint complex subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.42-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6208, or the activity of a polypeptide encoded by a nucleic acid molecule comprising the nucleic acid SEQ ID NO. 6208 or a polypeptide SEQ ID NO. 6209, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6208 or polypeptide SEQ ID NO. 6209, respectively, is increased or generated, or if the activity "nuclear pore complex subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.41-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6242, or the activity of a polypeptide encoded by a nucleic acid molecule comprising the nucleic acid SEQ ID NO. 6242 or a polypeptide SEQ ID NO. 6243, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6242 or polypeptide SEQ ID NO. 6243, respectively, is increased or generated, or if the activity "yjl064w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.30-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6246, or the activity of a polypeptide encoded by a nucleic acid molecule comprising the nucleic acid SEQ ID NO. 6246 or a polypeptide SEQ ID NO. 6247, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6246 or polypeptide SEQ ID NO. 6247, respectively, is increased or generated, or if the activity "yjl067w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.29-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6250, or the activity of a polypeptide encoded by a nucleic acid molecule comprising the nucleic acid SEQ ID NO. 6250 or a polypeptide SEQ ID NO. 6251, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6250 or polypeptide SEQ ID NO. 6251, respectively, is increased or generated, or if the activity "potassium:hydrogen antiporter" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.23-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6297, or the activity of a polypeptide encoded by a nucleic acid molecule comprising the nucleic acid SEQ ID NO. 6297 or a polypeptide SEQ ID NO. 6298, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6297 or polypeptide SEQ ID NO. 6298, respectively, is increased or generated, or if the activity "GPI-anchored cell wall protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6326, or the activity of a polypeptide encoded by a nucleic acid molecule comprising the nucleic acid SEQ ID NO. 6326 or a polypeptide SEQ ID NO. 6327, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6326 or polypeptide SEQ ID NO. 6327, respectively, is increased or generated, or if the activity "yjl213w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.62-fold plus at least 100% thereof under conditions of nitrogen deficiency is conferred; also particularly, an increase from 1.05-fold to 1.12-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 6488, or the activity of a polypeptide encoded by a nucleic acid molecule comprising the nucleic acid SEQ ID NO. 6488 or a polypeptide SEQ ID NO. 6489, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6488 or polypeptide SEQ ID NO. 6489, respectively, is increased or generated, or if the activity "peptidyl-prolyl cis-trans isomerase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.50-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 6550, or the activity of a polypeptide encoded by a nucleic acid molecule comprising the nucleic acid SEQ ID NO. 6550 or a polypeptide SEQ ID NO. 6551, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6550 or polypeptide SEQ ID NO. 6551, respectively, is increased or generated, or if the activity "clathrin associated protein complex small subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.28-fold plus at least 100% thereof under conditions of nitrogen deficiency is conferred; also particularly, an increase from 1.05-fold to 1.36-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 6700, or the activity of a polypeptide encoded by a nucleic acid molecule comprising the nucleic acid SEQ ID NO. 6700 or a polypeptide SEQ ID NO. 6701, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6700 or polypeptide SEQ ID NO. 6701, respectively, is increased or generated, or if the activity "zinc metalloprotease" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.81-fold plus at least 100% thereof under conditions of nitrogen deficiency is conferred; also particularly, an increase from 1.05-fold to 1.22-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 6816, or the activity of a polypeptide encoded by a nucleic acid molecule comprising the nucleic acid SEQ ID NO. 6816 or a polypeptide SEQ ID NO. 6817, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 6816 or polypeptide SEQ ID NO. 6817, respectively, is increased or generated, or if the activity "F1F0 ATP synthase beta subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.52-fold plus at least 100% thereof under conditions of nitrogen deficiency is conferred; also particularly, an increase from 1.05-fold to 1.37-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 7366, or the activity of a polypeptide encoded by a nucleic acid molecule comprising the nucleic acid SEQ ID NO. 7366 or a polypeptide SEQ ID NO. 7367, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7366 or polypeptide SEQ ID NO. 7367, respectively, is increased or generated, or if the activity "alpha-mannosidase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.52-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 7475, or the activity of a polypeptide encoded by a nucleic acid molecule comprising the nucleic acid SEQ ID NO. 7475 or a polypeptide SEQ ID NO. 7476, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7475 or polypeptide SEQ ID NO. 7476, respectively, is increased or generated, or if the activity "ribosomal protein of the small subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.41-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 7602, or the activity of a polypeptide encoded by a nucleic acid molecule comprising the nucleic acid SEQ ID NO. 7602 or a polypeptide SEQ ID NO. 7603, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7602 or polypeptide SEQ ID NO. 7603, respectively, is increased or generated, or if the activity "mitochondrial intermembrane space protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.20-fold plus at least 100% thereof under conditions of nitrogen deficiency is conferred; also particularly, an increase from 1.05-fold to 1.10-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 7651, or the activity of a polypeptide encoded by a nucleic acid molecule comprising the nucleic acid SEQ ID NO. 7651 or a polypeptide SEQ ID NO. 7652, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7651 or polypeptide SEQ ID NO. 7652, respectively, is increased or generated, or if the activity "phosphopantothenoylcysteine decarboxylase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.23-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 7661, or the activity of a polypeptide encoded by a nucleic acid molecule comprising the nucleic acid SEQ ID NO. 7661 or a polypeptide SEQ ID NO. 7662, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7661 or polypeptide SEQ ID NO. 7662, respectively, is increased or generated, or if the activity "ykl100c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.25-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 7675, or the activity of a polypeptide encoded by a nucleic acid molecule comprising the nucleic acid SEQ ID NO. 7675 or a polypeptide SEQ ID NO. 7676, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7675 or polypeptide SEQ ID NO. 7676, respectively, is increased or generated, or if the activity "ykl131w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.22-fold plus at least 100% thereof under conditions of nitrogen deficiency is conferred; as compared to a corresponding non-transformed wild type plant cell, a plant or a part thereof.

Accordingly, in one embodiment, in case the *Saccharomyces cerevisiae* nucleic acid molecule SEQ ID NO. 7679, or the activity of a polypeptide encoded by a nucleic acid molecule comprising the nucleic acid SEQ ID NO. 7679 or a polypeptide SEQ ID NO. 7680, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7679 or polypeptide SEQ ID NO. 7680, respectively, is increased or generated, or if the activity "mitochondrial ribosomal protein of the large subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.24-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 7710, or the activity of a polypeptide encoded by a nucleic acid molecule comprising the nucleic acid SEQ ID NO. 7710 or a polypeptide SEQ ID NO. 7711, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7710 or polypeptide SEQ ID NO. 7711, respectively, is increased or generated, or if the activity "G protein coupled pheromone receptor receptor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 2.69-fold plus at least 100% thereof under conditions of nitrogen deficiency is conferred; also particularly, an increase from 1.05-fold to 1.57-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 7735, or the activity of a polypeptide encoded by a nucleic acid molecule comprising the nucleic acid SEQ ID NO. 7735 or a polypeptide SEQ ID NO. 7736, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7735 or polypeptide SEQ ID NO. 7736, respectively, is increased or generated, or if the activity "golgi membrane protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.58-fold plus at least 100% thereof under conditions of nitrogen deficiency is conferred; also particularly, an increase from 1.05-fold to 1.22-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 7778, or the activity of a polypeptide encoded by a nucleic acid molecule comprising the nucleic acid SEQ ID NO. 7778 or a polypeptide SEQ ID NO. 7779, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7778 or polypeptide SEQ ID NO. 7779, respectively, is increased or generated, or if the activity "regulatory subunit of Glc7p type 1 protein serine-threonine phosphatase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.77-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 7829, or the activity of a polypeptide encoded by a nucleic acid molecule comprising the nucleic acid SEQ ID NO. 7829 or a polypeptide SEQ ID NO. 7830, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 7829 or polypeptide SEQ ID NO. 7830, respectively, is increased or generated, or if the activity "dihydroorotate dehydrogenase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 2.09-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8017, or the activity of a polypeptide encoded by a nucleic acid molecule comprising the nucleic acid SEQ ID NO. 8017 or a polypeptide SEQ ID NO. 8018, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8017 or polypeptide SEQ ID NO. 8018, respectively, is increased or generated, or if the activity "ykr016w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 2.00-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8045, or the activity of a polypeptide encoded by a nucleic acid molecule comprising the nucleic acid SEQ ID NO. 8045 or a polypeptide SEQ ID NO. 8046, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8045 or polypeptide SEQ ID NO. 8046, respectively, is increased or generated, or if the activity "ykr021w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 2.14-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8073, or the activity of a polypeptide encoded by a nucleic acid molecule comprising the nucleic acid SEQ ID NO. 8073 or a polypeptide SEQ ID NO. 8074, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8073 or polypeptide SEQ ID NO. 8074, respectively, is increased or generated, or if the activity "non-essential small GTPase of the Rho/Rac subfamily of Ras-like proteins" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.57-fold plus at least 100% thereof under conditions of nitrogen deficiency is conferred; also particularly, an increase from 1.05-fold to 1.09-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 8263, or the activity of a polypeptide encoded by a nucleic acid molecule comprising the nucleic acid SEQ ID NO. 8263 or a polypeptide SEQ ID NO. 8264, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8263 or polypeptide SEQ ID NO. 8264, respectively, is increased or generated, or if the activity "integral membrane protein localized to late Golgi vesicles" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.29-fold plus at least 100% thereof under conditions of nitrogen deficiency is conferred; also particularly, an increase from 1.05-fold to 1.20-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 8287, or the activity of a polypeptide encoded by a nucleic acid molecule comprising the nucleic acid SEQ ID NO. 8287 or a polypeptide SEQ ID NO. 8288, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8287 or polypeptide SEQ ID NO. 8288, respectively, is increased or generated, or if the activity "peptide transporter" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 3.98-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8468, or the activity of a polypeptide encoded by a nucleic acid molecule comprising the nucleic acid SEQ ID NO. 8468 or a polypeptide SEQ ID NO. 8469, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8468 or polypeptide SEQ ID NO. 8469, respectively, is increased or generated, or if the activity "transcription factor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.15-fold plus at least 100% thereof under conditions of nitrogen deficiency is conferred; also particularly, an increase from 1.05-fold to 1.50-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 8484, or the activity of a polypeptide encoded by a nucleic acid molecule comprising the nucleic acid SEQ ID NO. 8484 or a polypeptide SEQ ID NO. 8485, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8484 or polypeptide SEQ ID NO. 8485, respectively, is increased or generated, or if the activity "transmembrane protein with a role in cell wall polymer composition" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 4.43-fold plus at least 100% thereof under conditions of nitrogen deficiency is conferred; also particularly, an increase from 1.05-fold to 1.12-fold plus at least 100% thereof under low temperature conditions; also particularly, an increase from 1.05-fold to 1.30-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 8492, or the activity of a polypeptide encoded by a nucleic acid molecule comprising the nucleic acid SEQ ID NO. 8492 or a polypeptide SEQ ID NO. 8493, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8492 or polypeptide SEQ ID NO. 8493, respectively, is increased or generated, or if the activity "yll014w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.61-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8514, or the activity of a polypeptide encoded by a nucleic acid molecule comprising the nucleic acid SEQ ID NO. 8514 or a polypeptide SEQ ID NO. 8515, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8514 or polypeptide SEQ ID NO. 8515, respectively, is increased or generated, or if the activity "non-essential Ras guanine nucleotide exchange factor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.24-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8539, or the activity of a polypeptide encoded by a nucleic acid molecule comprising the nucleic acid SEQ ID NO. 8539 or a polypeptide SEQ ID NO. 8540, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8539 or polypeptide SEQ ID NO. 8540, respectively, is increased or generated, or if the activity "yll023c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.17-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8571, or the activity of a polypeptide encoded by a nucleic acid molecule comprising the nucleic acid SEQ ID NO. 8571 or a polypeptide SEQ ID NO. 8572, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8571 or polypeptide SEQ ID NO. 8572, respectively, is increased or generated, or if the activity "yll037w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.32-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8575, or the activity of a polypeptide encoded by a nucleic acid molecule comprising the nucleic acid SEQ ID NO. 8575 or a polypeptide SEQ ID NO. 8576, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8575 or polypeptide SEQ ID NO. 8576, respectively, is increased or generated, or if the activity "yll049w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.75-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8579, or the activity of a polypeptide encoded by a nucleic acid molecule comprising the nucleic acid SEQ ID NO. 8579 or a polypeptide SEQ ID NO. 8580, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8579 or polypeptide SEQ ID NO. 8580, respectively, is increased or generated, or if the activity "cysteine transporter" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 5.25-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8661, or the activity of a polypeptide encoded by a nucleic acid molecule comprising the nucleic acid SEQ ID NO. 8661 or a polypeptide SEQ ID NO. 8662, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8661 or polypeptide SEQ ID NO. 8662, respectively, is increased or generated, or if the activity "metal ion transporter" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 4.38-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8991, or the activity of a polypeptide encoded by a nucleic acid molecule comprising the nucleic acid SEQ ID NO. 8991 or a polypeptide SEQ ID NO. 8992, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8991 or polypeptide SEQ ID NO. 8992, respectively, is increased or generated, or if the activity "ylr042c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.40-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 8995, or the activity of a polypeptide encoded by a nucleic acid molecule comprising the nucleic acid SEQ ID NO. 8995 or a polypeptide SEQ ID NO. 8996, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8995 or polypeptide SEQ ID NO. 8996, respectively, is increased or generated, or if the activity "YLR053c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.55-fold plus at least 100% thereof under conditions of nitrogen deficiency is conferred; also particularly, an increase from 1.05-fold to 1.17-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 8999, or the activity of a polypeptide encoded by a nucleic acid molecule comprising the nucleic acid SEQ ID NO. 8999 or a polypeptide SEQ ID NO. 9000, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 8999 or polypeptide SEQ ID NO. 9000, respectively, is increased or generated, or if the activity "cytosolic serine hydroxymethyltransferase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 9551, or the activity of a polypeptide encoded by a nucleic acid molecule comprising the nucleic acid SEQ ID NO. 9551 or a polypeptide SEQ ID NO. 9552, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 9551 or polypeptide SEQ ID NO. 9552, respectively, is increased or generated, or if the activity "subunit of cytoplasmic phenylalanyl-tRNA synthetase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 3.72-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 9637, or the activity of a polypeptide encoded by a nucleic acid molecule comprising the nucleic acid SEQ ID NO. 9637 or a polypeptide SEQ ID NO. 9638, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 9637 or polypeptide SEQ ID NO. 9638, respectively, is increased or generated, or if the activity "ylr065c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.88-fold plus at least 100% thereof under conditions of nitrogen deficiency is conferred; also particularly, an increase from 1.05-fold to 1.24-fold plus at least 100% thereof under drought conditions; as compared to a corresponding non-transformed wild type plant cell, a plant or a part thereof. Accordingly, in one embodiment, in case the *Saccharomyces cerevisiae* nucleic acid molecule SEQ ID NO. 9672, or the activity of a polypeptide encoded by a nucleic acid molecule comprising the nucleic acid SEQ ID NO. 9672 or a polypeptide SEQ ID NO. 9673, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 9672 or polypeptide SEQ ID NO. 9673, respectively, is increased or generated, or if the activity "xylitol dehydrogenase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 2.66-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 10182, or the activity of a polypeptide encoded by a nucleic acid molecule comprising the nucleic acid SEQ ID NO. 10182 or a polypeptide SEQ ID NO. 10183, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10182 or polypeptide SEQ ID NO. 10183, respectively, is increased or generated, or if the activity "3-keto sterol reductase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.57-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 10214, or the activity of a polypeptide encoded by a nucleic acid molecule comprising the nucleic acid SEQ ID NO. 10214 or a polypeptide SEQ ID NO. 10215, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10214 or polypeptide SEQ ID NO. 10215, respectively, is increased or generated, or if the activity "alkyl hydroperoxide reductase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.55-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 10447, or the activity of a polypeptide encoded by a nucleic acid molecule comprising the nucleic acid SEQ ID NO. 10447 or a polypeptide SEQ ID NO. 10448, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10447 or polypeptide SEQ ID NO. 10448, respectively, is increased or generated, or if the activity "ylr125w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.28-fold plus at least 100% thereof under conditions of nitrogen deficiency is conferred; as compared to a corresponding non-transformed wild type plant cell, a plant or a part thereof.

Accordingly, in one embodiment, in case the *Saccharomyces cerevisiae* nucleic acid molecule SEQ ID NO. 10451, or the activity of a polypeptide encoded by a nucleic acid molecule comprising the nucleic acid SEQ ID NO. 10451 or a polypeptide SEQ ID NO. 10452, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10451 or polypeptide SEQ ID NO. 10452, respectively, is increased or generated, or if the activity "anaphase promoting complex (APC) subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.22-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 10463, or the activity of a polypeptide encoded by a nucleic acid molecule comprising the nucleic acid SEQ ID NO. 10463 or a polypeptide SEQ ID NO. 10464, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10463 or polypeptide SEQ ID NO. 10464, respectively, is increased or generated, or if the activity "protein component of the large ribosomal subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.14-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 10533, or the activity of a polypeptide encoded by a nucleic acid molecule comprising the nucleic acid SEQ ID NO. 10533 or a polypeptide SEQ ID NO. 10534, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10533 or polypeptide SEQ ID NO. 10534, respectively, is increased or generated, or if the activity "mitochondrial protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.38-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 10533, or the activity of a polypeptide encoded by a nucleic acid molecule comprising the nucleic acid SEQ ID NO. 10533 or a polypeptide SEQ ID NO. 10534, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10533 or polypeptide SEQ ID NO. 10534, respectively, is increased or generated, or if the activity "mitochondrial protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.05-fold to 1.22-fold plus at least 100% thereof under low temperature conditions is conferred as compared to a corresponding non-transformed wild type plant cell, a plant or a part thereof.

Accordingly, in one embodiment, in case the *Saccharomyces cerevisiae* nucleic acid molecule SEQ ID NO. 10541, or the activity of a polypeptide encoded by a nucleic acid molecule comprising the nucleic acid SEQ ID NO. 10541 or a polypeptide SEQ ID NO. 10542, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10541 or polypeptide SEQ ID NO. 10542, respectively, is increased or generated, or if the activity "ARV1 protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.61-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 10562, or the activity of a polypeptide encoded by a nucleic acid molecule comprising the nucleic acid SEQ ID NO. 10562 or a polypeptide SEQ ID NO. 10563, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10562 or polypeptide SEQ ID NO. 10563, respectively, is increased or generated, or if the activity "GTP-binding protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 2.75-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 10990, or the activity of a polypeptide encoded by a nucleic acid molecule comprising the nucleic acid SEQ ID NO. 10990 or a polypeptide SEQ ID NO. 10991, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10990 or polypeptide SEQ ID NO. 10991, respectively, is increased or generated, or if the activity "protein involved in shmoo formation and bipolar bud site selection" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.25-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 10998, or the activity of a polypeptide encoded by a nucleic acid molecule comprising the nucleic acid SEQ ID NO. 10998 or a polypeptide SEQ ID NO. 10999, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 10998 or polypeptide SEQ ID NO. 10999, respectively, is increased or generated, or if the activity "non-essential kinetochore protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.54-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11004, or the activity of a polypeptide encoded by a nucleic acid molecule comprising the nucleic acid SEQ ID NO. 11004 or a polypeptide SEQ ID NO. 11005, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11004 or polypeptide SEQ ID NO. 11005, respectively, is increased or generated, or if the activity "Meiotic recombination protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.27-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11012, or the activity of a polypeptide encoded by a nucleic acid molecule comprising the nucleic acid SEQ ID NO. 11012 or a polypeptide SEQ ID NO. 11013, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11012 or polypeptide SEQ ID NO. 11013, respectively, is increased or generated, or if the activity "signal transducing MEK kinase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 3.40-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11054, or the activity of a polypeptide encoded by a nucleic acid molecule comprising the nucleic acid SEQ ID NO. 11054 or a polypeptide SEQ ID NO. 11055, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11054 or polypeptide SEQ ID NO. 11055, respectively, is increased or generated, or if the activity "cytochrome c oxidase subunit VIII" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.56-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11066, or the activity of a polypeptide encoded by a nucleic acid molecule comprising the nucleic acid SEQ ID NO. 11066 or a polypeptide SEQ ID NO. 11067, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11066 or polypeptide SEQ ID NO. 11067, respectively, is increased or generated, or if the activity "ylr404w-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.33-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11074, or the activity of a polypeptide encoded by a nucleic acid molecule comprising the nucleic acid SEQ ID NO. 11074 or a polypeptide SEQ ID NO. 11075, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11074 or polypeptide SEQ ID NO. 11075, respectively, is increased or generated, or if the activity "ylr463c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.33-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11080, or the activity of a polypeptide encoded by a nucleic acid molecule comprising the nucleic acid SEQ ID NO. 11080 or a polypeptide SEQ ID NO. 11081, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11080 or polypeptide SEQ ID NO. 11081, respectively, is increased or generated, or if the activity "adenine phosphoribosyltransferase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.27-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11552, or the activity of a polypeptide encoded by a nucleic acid molecule comprising the nucleic acid SEQ ID NO. 11552 or a polypeptide SEQ ID NO. 11553, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11552 or polypeptide SEQ ID NO. 11553, respectively, is increased or generated, or if the activity "Mcm1p binding transcriptional repressor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.42-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11569, or the activity of a polypeptide encoded by a nucleic acid molecule comprising the nucleic acid SEQ ID NO. 11569 or a polypeptide SEQ ID NO. 11570, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11569 or polypeptide SEQ ID NO. 11570, respectively, is increased or generated, or if the activity "origin recognition complex subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.14-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11596, or the activity of a polypeptide encoded by a nucleic acid molecule comprising the nucleic acid SEQ ID NO. 11596 or a polypeptide SEQ ID NO. 11597, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11596 or polypeptide SEQ ID NO. 11597, respectively, is increased or generated, or if the activity "yml089c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.17-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11600, or the activity of a polypeptide encoded by a nucleic acid molecule comprising the nucleic acid SEQ ID NO. 11600 or a polypeptide SEQ ID NO. 11601, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11600 or polypeptide SEQ ID NO. 11601, respectively, is increased or generated, or if the activity "yml128c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.12-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 11612, or the activity of a polypeptide encoded by a nucleic acid molecule comprising the nucleic acid SEQ ID NO. 11612 or a polypeptide SEQ ID NO. 11613, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 11612 or polypeptide SEQ ID NO. 11613, respectively, is increased or generated, or if the activity "hexose transporter" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.52-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12246, or the activity of a polypeptide encoded by a nucleic acid molecule comprising the nucleic acid SEQ ID NO. 12246 or a polypeptide SEQ ID NO. 12247, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12246 or polypeptide SEQ ID NO. 12247, respectively, is increased or generated, or if the activity "Zinc finger protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.41-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12263, or the activity of a polypeptide encoded by a nucleic acid molecule comprising the nucleic acid SEQ ID NO. 12263 or a polypeptide SEQ ID NO. 12264, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12263 or polypeptide SEQ ID NO. 12264, respectively, is increased or generated, or if the activity "protein required for maturation of ribosomal RNAs" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 3.71-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12316, or the activity of a polypeptide encoded by a nucleic acid molecule comprising the nucleic acid SEQ ID NO. 12316 or a polypeptide SEQ ID NO. 12317, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12316 or polypeptide SEQ ID NO. 12317, respectively, is increased or generated, or if the activity "Factor arrest protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.28-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12327, or the activity of a polypeptide encoded by a nucleic acid molecule comprising the nucleic acid SEQ ID NO. 12327 or a polypeptide SEQ ID NO. 12328, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12327 or polypeptide SEQ ID NO. 12328, respectively, is increased or generated, or if the activity "YMR082C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.26-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12331, or the activity of a polypeptide encoded by a nucleic acid molecule comprising the nucleic acid SEQ ID NO. 12331 or a polypeptide SEQ ID NO. 12332, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12331 or polypeptide SEQ ID NO. 12332, respectively, is increased or generated, or if the activity "Nuclear cap-binding protein complex subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.24-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12378, or the activity of a polypeptide encoded by a nucleic acid molecule comprising the nucleic acid SEQ ID NO. 12378 or a polypeptide SEQ ID NO. 12379, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12378 or polypeptide SEQ ID NO. 12379, respectively, is increased or generated, or if the activity "YMR126C membrane protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12394, or the activity of a polypeptide encoded by a nucleic acid molecule comprising the nucleic acid SEQ ID NO. 12394 or a polypeptide SEQ ID NO. 12395, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12394 or polypeptide SEQ ID NO. 12395, respectively, is increased or generated, or if the activity "YMR144W-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.36-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12406, or the activity of a polypeptide encoded by a nucleic acid molecule comprising the nucleic acid SEQ ID NO. 12406 or a polypeptide SEQ ID NO. 12407, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12406 or polypeptide SEQ ID NO. 12407, respectively, is increased or generated, or if the activity "YMR160W-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.29-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12414, or the activity of a polypeptide encoded by a nucleic acid molecule comprising the nucleic acid SEQ ID NO. 12414 or a polypeptide SEQ ID NO. 12415, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12414 or polypeptide SEQ ID NO. 12415, respectively, is increased or generated, or if the activity "Stationary phase protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.51-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12420, or the activity of a polypeptide encoded by a nucleic acid molecule comprising the nucleic acid SEQ ID NO. 12420 or a polypeptide SEQ ID NO. 12421, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12420 or polypeptide SEQ ID NO. 12421, respectively, is increased or generated, or if the activity "YMR209C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.18-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12440, or the activity of a polypeptide encoded by a nucleic acid molecule comprising the nucleic acid SEQ ID NO. 12440 or a polypeptide SEQ ID NO. 12441, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12440 or polypeptide SEQ ID NO. 12441, respectively, is increased or generated, or if the activity "YMR233W-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.61-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12470, or the activity of a polypeptide encoded by a nucleic acid molecule comprising the nucleic acid SEQ ID NO. 12470 or a polypeptide SEQ ID NO. 12471, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12470 or polypeptide SEQ ID NO. 12471, respectively, is increased or generated, or if the activity "phosphoglucomutase/phosphomannomutase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.20-fold plus at least 100% thereof under conditions of nitrogen deficiency is conferredas compared to a corresponding non-transformed wild type plant cell, a plant or a part thereof.

Accordingly, in one embodiment, in case the *Saccharomyces cerevisiae* nucleic acid molecule SEQ ID NO. 12749, or the activity of a polypeptide encoded by a nucleic acid molecule comprising the nucleic acid SEQ ID NO. 12749 or a polypeptide SEQ ID NO. 12750, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12749 or polypeptide SEQ ID NO. 12750, respectively, is increased or generated, or if the activity "Regulatory CAT8 protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.31-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12773, or the activity of a polypeptide encoded by a nucleic acid molecule comprising the nucleic acid SEQ ID NO. 12773 or a polypeptide SEQ ID NO. 12774, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12773 or polypeptide SEQ ID NO. 12774, respectively, is increased or generated, or if the activity "translational elongation factor EF-3 (HEF3)" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred; also particularly, an increase from 1.05-fold to 1.11-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 12829, or the activity of a polypeptide encoded by a nucleic acid molecule comprising the nucleic acid SEQ ID NO. 12829 or a polypeptide SEQ ID NO. 12830, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12829 or polypeptide SEQ ID NO. 12830, respectively, is increased or generated, or if the activity "YNL320W-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.46-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12883, or the activity of a polypeptide encoded by a nucleic acid molecule comprising the nucleic acid SEQ ID NO. 12883 or a polypeptide SEQ ID NO. 12884, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12883 or polypeptide SEQ ID NO. 12884, respectively, is increased or generated, or if the activity "Chitin synthase 3 complex protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.15-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 12889, or the activity of a polypeptide encoded by a nucleic acid molecule comprising the nucleic acid SEQ ID NO. 12889 or a polypeptide SEQ ID NO. 12890, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 12889 or polypeptide SEQ ID NO. 12890, respectively, is increased or generated, or if the activity "Alkyl/aryl-sulfatase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred; as compared to a corresponding non-transformed wild type plant cell, a plant or a part thereof.

Accordingly, in one embodiment, in case the *Saccharomyces cerevisiae* nucleic acid molecule SEQ ID NO. 13014, or the activity of a polypeptide encoded by a nucleic acid molecule comprising the nucleic acid SEQ ID NO. 13014 or a polypeptide SEQ ID NO. 13015, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 13014 or polypeptide SEQ ID NO. 13015, respectively, is increased or generated, or if the activity "antiviral adaptor protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.10-fold plus at least 100% thereof under conditions of nitrogen deficiency is conferred; as compared to a corresponding non-transformed wild type plant cell, a plant or a part thereof.

Accordingly, in one embodiment, in case the *Saccharomyces cerevisiae* nucleic acid molecule SEQ ID NO. 13018, or the activity of a polypeptide encoded by a nucleic acid molecule comprising the nucleic acid SEQ ID NO. 13018 or a polypeptide SEQ ID NO. 13019, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 13018 or polypeptide SEQ ID NO. 13019, respectively, is increased or generated, or if the activity "repressor of G1 transcription" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.48-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 13024, or the activity of a polypeptide encoded by a nucleic acid molecule comprising the nucleic acid SEQ ID NO. 13024 or a polypeptide SEQ ID NO. 13025, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 13024 or polypeptide SEQ ID NO. 13025, respectively, is increased or generated, or if the activity "YOR097C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.19-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 13030, or the activity of a polypeptide encoded by a nucleic acid molecule comprising the nucleic acid SEQ ID NO. 13030 or a polypeptide SEQ ID NO. 13031, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 13030 or polypeptide SEQ ID NO. 13031, respectively, is increased or generated, or if the activity "Phosphoribosylaminoimidazole carboxylase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.46-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 14085, or the activity of a polypeptide encoded by a nucleic acid molecule comprising the nucleic acid SEQ ID NO. 14085 or a polypeptide SEQ ID NO. 14086, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14085 or polypeptide SEQ ID NO. 14086, respectively, is increased or generated, or if the activity "component of the RAM signaling network" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.26-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 14093, or the activity of a polypeptide encoded by a nucleic acid molecule comprising the nucleic acid SEQ ID NO. 14093 or a polypeptide SEQ ID NO. 14094, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14093 or polypeptide SEQ ID NO. 14094, respectively, is increased or generated, or if the activity "protein kinase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.33-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 14113, or the activity of a polypeptide encoded by a nucleic acid molecule comprising the nucleic acid SEQ ID NO. 14113 or a polypeptide SEQ ID NO. 14114, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14113 or polypeptide SEQ ID NO. 14114, respectively, is increased or generated, or if the activity "signal recognition particle subunit (SRP54)" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.61-fold plus at least 100% thereof under conditions of nitrogen deficiency is conferred; also particularly, an increase from 1.05-fold to 1.26-fold plus at least 100% thereof under low temperature conditions; as compared to a corresponding non-transformed wild type plant cell, a plant or a part thereof. Accordingly, in one embodiment, in case the *Saccharomyces cerevisiae* nucleic acid molecule SEQ ID NO. 14246, or the activity of a polypeptide encoded by a nucleic acid molecule comprising the nucleic acid SEQ ID NO. 14246 or a polypeptide SEQ ID NO. 14247, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14246 or polypeptide SEQ ID NO. 14247, respectively, is increased or generated, or if the activity "regulatory subunit of the 26S proteasome" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.25-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 14311, or the activity of a polypeptide encoded by a nucleic acid molecule comprising the nucleic acid SEQ ID NO. 14311 or a polypeptide SEQ ID NO. 14312, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14311 or polypeptide SEQ ID NO. 14312, respectively, is increased or generated, or if the activity "RNA polymerase III subunit" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.22-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 14914, or the activity of a polypeptide encoded by a nucleic acid molecule comprising the nucleic acid SEQ ID NO. 14914 or a polypeptide SEQ ID NO. 14915, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14914 or polypeptide SEQ ID NO. 14915, respectively, is increased or generated, or if the activity "lysophospholipase" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.42-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15382, or the activity of a polypeptide encoded by a nucleic acid molecule comprising the nucleic acid SEQ ID NO. 15382 or a polypeptide SEQ ID NO. 15383, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15382 or polypeptide SEQ ID NO. 15383, respectively, is increased or generated, or if the activity "saccharopine dehydrogenase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 2.42-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15460, or the activity of a polypeptide encoded by a nucleic acid molecule comprising the nucleic acid SEQ ID NO. 15460 or a polypeptide SEQ ID NO. 15461, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15460 or polypeptide SEQ ID NO. 15461, respectively, is increased or generated, or if the activity "alpha-mannosidase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.52-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15571, or the activity of a polypeptide encoded by a nucleic acid molecule comprising the nucleic acid SEQ ID NO. 15571 or a polypeptide SEQ ID NO. 15572, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15571 or polypeptide SEQ ID NO. 15572, respectively, is increased or generated, or if the activity "ykl100c-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.25-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15593, or the activity of a polypeptide encoded by a nucleic acid molecule comprising the nucleic acid SEQ ID NO. 15593 or a polypeptide SEQ ID NO. 15594, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15593 or polypeptide SEQ ID NO. 15594, respectively, is increased or generated, or if the activity "regulatory subunit of Glc7p type 1 protein serine-threonine phosphatase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.77-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15646, or the activity of a polypeptide encoded by a nucleic acid molecule comprising the nucleic acid SEQ ID NO. 15646 or a polypeptide SEQ ID NO. 15647, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15646 or polypeptide SEQ ID NO. 15647, respectively, is increased or generated, or if the activity "non-essential Ras guanine nucleotide exchange factor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.24-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15673, or the activity of a polypeptide encoded by a nucleic acid molecule comprising the nucleic acid SEQ ID NO. 15673 or a polypeptide SEQ ID NO. 15674, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15673 or polypeptide SEQ ID NO. 15674, respectively, is increased or generated, or if the activity "metal ion transporter" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 4.38-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16005, or the activity of a polypeptide encoded by a nucleic acid molecule comprising the nucleic acid SEQ ID NO. 16005 or a polypeptide SEQ ID NO. 16006, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16005 or polypeptide SEQ ID NO. 16006, respectively, is increased or generated, or if the activity "subunit of cytoplasmic phenylalanyl-tRNA synthetase" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 3.72-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16114, or the activity of a polypeptide encoded by a nucleic acid molecule comprising the nucleic acid SEQ ID NO. 16114 or a polypeptide SEQ ID NO. 16115, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16114 or polypeptide SEQ ID NO. 16115, respectively, is increased or generated, or if the activity "YMR082C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.26-fold plus at least 100% thereof under conditions of nitrogen deficiency is conferredas compared to a corresponding non-transformed wild type plant cell, a plant or a part thereof.

Accordingly, in one embodiment, in case the *Escherichia coli* nucleic acid molecule SEQ ID NO. 14402, or the activity of a polypeptide encoded by a nucleic acid molecule comprising the nucleic acid SEQ ID NO. 14402 or a polypeptide SEQ ID NO. 14403, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14402 or polypeptide SEQ ID NO. 14403, respectively, is increased or generated, or if the activity "B1258-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.36-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16093, or the activity of a polypeptide encoded by a nucleic acid molecule comprising the nucleic acid SEQ ID NO. 16093 or a polypeptide SEQ ID NO. 16094, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16093 or polypeptide SEQ ID NO. 16094, respectively, is increased or generated, or if the activity "YML101C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.35-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16106, or the activity of a polypeptide encoded by a nucleic acid molecule comprising the nucleic acid SEQ ID NO. 16106 or a polypeptide SEQ ID NO. 16107, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16106 or polypeptide SEQ ID NO. 16107, respectively, is increased or generated, or if the activity "nuclear fusion protein precursor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.28-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16120, or the activity of a polypeptide encoded by a nucleic acid molecule comprising the nucleic acid SEQ ID NO. 16120 or a polypeptide SEQ ID NO. 16121, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16120 or polypeptide SEQ ID NO. 16121, respectively, is increased or generated, or if the activity "inheritance of peroxisomes protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16275, or the activity of a polypeptide encoded by a nucleic acid molecule comprising the nucleic acid SEQ ID NO. 16275 or a polypeptide SEQ ID NO. 16276, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16275 or polypeptide SEQ ID NO. 16276, respectively, is increased or generated, or if the activity "exoribonuclease" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, plant or a part thereof is conferred, or in particular an enhancement of NUE, or in particular an increase of biomass production, or an enhancement of NUE and an increase of biomass production.

Particularly, an increase from 1.1-fold to 1.16-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16305, or the activity of a polypeptide encoded by a nucleic acid molecule comprising the nucleic acid SEQ ID NO. 16305 or a polypeptide SEQ ID NO. 16306, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16305 or polypeptide SEQ ID NO. 16306, respectively, is increased or generated, or if the activity "iron sulfur cluster assembly protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.24-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16573, or the activity of a polypeptide encoded by a nucleic acid molecule comprising the nucleic acid SEQ ID NO. 16573 or a polypeptide SEQ ID NO. 16574, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16573 or polypeptide SEQ ID NO. 16574, respectively, is increased or generated, or if the activity "YPL068C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.11-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 14396, or the activity of a polypeptide encoded by a nucleic acid molecule comprising the nucleic acid SEQ ID NO. 14396 or a polypeptide SEQ ID NO. 14397, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14396 or polypeptide SEQ ID NO. 14397, respectively, is increased or generated, or if the activity "B0165-protein" is increased or generated in an plant cell, plant or part thereof, especially with plastidic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.14-fold plus at least 100% thereof under conditions of nitrogen deficiency is conferred; also particularly, an increase from 1.05-fold to 1.08-fold plus at least 100% thereof under low temperature conditions; also particularly, an increase from 1.05-fold to 1.79-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 16299, or the activity of a polypeptide encoded by a nucleic acid molecule comprising the nucleic acid SEQ ID NO. 16299 or a polypeptide SEQ ID NO. 16300, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16299 or polypeptide SEQ ID NO. 16300, respectively, is increased or generated, or if the activity "YOR203W-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.21-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16133, or the activity of a polypeptide encoded by a nucleic acid molecule comprising the nucleic acid SEQ ID NO. 16133 or a polypeptide SEQ ID NO. 16134, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16133 or polypeptide SEQ ID NO. 16134, respectively, is increased or generated, or if the activity "ribonucleoprotein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.15-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15056, or the activity of a polypeptide encoded by a nucleic acid molecule comprising the nucleic acid SEQ ID NO. 15056 or a polypeptide SEQ ID NO. 15057, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15056 or polypeptide SEQ ID NO. 15057, respectively, is increased or generated, or if the activity "transcription factor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.11-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15587, or the activity of a polypeptide encoded by a nucleic acid molecule comprising the nucleic acid SEQ ID NO. 15587 or a polypeptide SEQ ID NO. 15588, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15587 or polypeptide SEQ ID NO. 15588, respectively, is increased or generated, or if the activity "YKL111C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.11-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16582, or the activity of a polypeptide encoded by a nucleic acid molecule comprising the nucleic acid SEQ ID NO. 16582 or a polypeptide SEQ ID NO. 16583, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16582 or polypeptide SEQ ID NO. 16583, respectively, is increased or generated, or if the activity "iron sulfur cluster assembly protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.13-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 14839, or the activity of a polypeptide encoded by a nucleic acid molecule comprising the nucleic acid SEQ ID NO. 14839 or a polypeptide SEQ ID NO. 14840, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14839 or polypeptide SEQ ID NO. 14840, respectively, is increased or generated, or if the activity "transport protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.16-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 15014, or the activity of a polypeptide encoded by a nucleic acid molecule comprising the nucleic acid SEQ ID NO. 15014 or a polypeptide SEQ ID NO. 15015, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15014 or polypeptide SEQ ID NO. 15015, respectively, is increased or generated, or if the activity "protein translocase protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.42-fold plus at least 100% thereof under conditions of nitrogen deficiency is conferredas compared to a corresponding non-transformed wild type plant cell, a plant or a part thereof.

Accordingly, in one embodiment, in case the *Saccharomyces cerevisiae* nucleic acid molecule SEQ ID NO. 15432, or the activity of a polypeptide encoded by a nucleic acid molecule comprising the nucleic acid SEQ ID NO. 15432 or a polypeptide SEQ ID NO. 15433, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15432 or polypeptide SEQ ID NO. 15433, respectively, is increased or generated, or if the activity "YJL010C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.11-fold plus at least 100% thereof under conditions of nitrogen deficiency is conferred; also particularly, an increase from 1.05-fold to 1.47-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 14497, or the activity of a polypeptide encoded by a nucleic acid molecule comprising the nucleic acid SEQ ID NO. 14497 or a polypeptide SEQ ID NO. 14498, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14497 or polypeptide SEQ ID NO. 14498, respectively, is increased or generated, or if the activity "B1267-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.23-fold plus at least 100% thereof under conditions of nitrogen deficiency is conferred; as compared to a corresponding non-transformed wild type plant cell, a plant or a part thereof.

Accordingly, in one embodiment, in case the *Escherichia coli* nucleic acid molecule SEQ ID NO. 14718, or the activity of a polypeptide encoded by a nucleic acid molecule comprising the nucleic acid SEQ ID NO. 14718 or a polypeptide SEQ ID NO. 14719, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14718 or polypeptide SEQ ID NO. 14719, respectively, is increased or generated, or if the activity "membrane protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.33-fold plus at least 100% thereof under conditions of nitrogen deficiency is conferred; also particularly, an increase from 1.05-fold to 1.06-fold plus at least 100% thereof under low temperature conditions; also particularly, an increase from 1.05-fold to 1.20-fold plus at least 100% thereof of yield in the absence of nutrient deficiency as well as stress conditions; as compared to a corresponding non-transformed wild type plant cell, a plant or a part thereof.

Accordingly, in one embodiment, in case the *Escherichia coli* nucleic acid molecule SEQ ID NO. 14791, or the activity of a polypeptide encoded by a nucleic acid molecule comprising the nucleic acid SEQ ID NO. 14791 or a polypeptide SEQ ID NO. 14792, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14791 or polypeptide SEQ ID NO. 14792, respectively, is increased or generated, or if the activity "B1381-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.11-fold plus at least 100% thereof under conditions of nitrogen deficiency is conferred as compared to a corresponding non-transformed wild type plant cell, a plant or a part thereof.

Accordingly, in one embodiment, in case the *Escherichia coli* nucleic acid molecule SEQ ID NO. 14879, or the activity of a polypeptide encoded by a nucleic acid molecule comprising the nucleic acid SEQ ID NO. 14879 or a polypeptide SEQ ID NO. 14880, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 14879 or polypeptide SEQ ID NO. 14880, respectively, is increased or generated, or if the activity "B2646-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.31-fold plus at least 100% thereof under conditions of nitrogen deficiency is conferred; also particularly, an increase from 1.05-fold to 1.11-fold plus at least 100% thereof under low temperature conditions; also particularly, an increase from 1.05-fold to 1.23-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 15064, or the activity of a polypeptide encoded by a nucleic acid molecule comprising the nucleic acid SEQ ID NO. 15064 or a polypeptide SEQ ID NO. 15065, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15064 or polypeptide SEQ ID NO. 15065, respectively, is increased or generated, or if the activity "60S ribosomal protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.12-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15257, or the activity of a polypeptide encoded by a nucleic acid molecule comprising the nucleic acid SEQ ID NO. 15257 or a polypeptide SEQ ID NO. 15258, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15257 or polypeptide SEQ ID NO. 15258, respectively, is increased or generated, or if the activity "Rho GDP-dissociation inhibitor" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.33-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 15378, or the activity of a polypeptide encoded by a nucleic acid molecule comprising the nucleic acid SEQ ID NO. 15378 or a polypeptide SEQ ID NO. 15379, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 15378 or polypeptide SEQ ID NO. 15379, respectively, is increased or generated, or if the activity "YHL005C-protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.25-fold plus at least 100% thereof under conditions of nitrogen deficiency is conferred as compared to a corresponding non-transformed wild type plant cell, a plant or a part thereof.

Accordingly, in one embodiment, in case the *Saccharomyces cerevisiae* nucleic acid molecule SEQ ID NO. 16629, or the activity of a polypeptide encoded by a nucleic acid molecule comprising the nucleic acid SEQ ID NO. 16629 or a polypeptide SEQ ID NO. 16630, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16629 or polypeptide SEQ ID NO. 16630, respectively, is increased or generated, or if the activity "transmembrane protein with a role in cell wall polymer composition" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 4.43-fold plus at least 100% thereof under conditions of nitrogen deficiency is conferred; also particularly, an increase from 1.05-fold to 1.12-fold plus at least 100% thereof under low temperature conditions; also particularly, an increase from 1.05-fold to 1.30-fold plus at least 100% thereof of yield in the absence of nutrient deficiency as well as stress conditions; as compared to a corresponding non-transformed wild type plant cell, a plant or a part thereof.

Accordingly, in one embodiment, in case the *Saccharomyces cerevisiae* nucleic acid molecule SEQ ID NO. 16647, or the activity of a polypeptide encoded by a nucleic acid molecule comprising the nucleic acid SEQ ID NO. 16647 or a polypeptide SEQ ID NO. 16648, respectively, is increased or generated, e.g. if the activity of such a nucleic acid molecule or a polypeptide comprising the nucleic acid or polypeptide or the consensus sequence or the polypeptide motif, as depicted in table I, II or IV, application no. 1, column 7 in the respective same line as the nucleic acid molecule SEQ ID NO. 16647 or polypeptide SEQ ID NO. 16648, respectively, is increased or generated, or if the activity "Stationary phase protein" is increased or generated in an plant cell, plant or part thereof, especially with cytoplasmic localization, an increase of yield as compared to a corresponding non-transformed wild type plant cell, plant or a part thereof is conferred, especially an enhanced nutrient use efficiency and/or an increased stress tolerance and/or an increased yield, in the absence of a nutrient deficiency as well as stress conditions, in particular an enhancement of NUE and/or an increase of biomass production as compared to a corresponding non-transformed wild type plant cell, a plant or a part thereof is conferred, or in particular an enhancement of NUE, or in particular an increase of biomass production, or an enhancement of NUE and an increase of biomass production.

Particularly, an increase from 1.1-fold to 1.51-fold plus at least 100% thereof under conditions of nitrogen deficiency is conferred as compared to a corresponding non-transformed wild type plant cell, a plant or a part thereof.

The ratios indicated above particularly refer to an increased yield actually measured as increase of biomass, especially as fresh weight biomass of aerial parts.

For the purposes of the invention, as a rule the plural is intended to encompass the singular and vice versa.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, the terms "gene(s)", "polynucleotide", "nucleic acid sequence", "nucleotide sequence", or "nucleic acid molecule(s)" as used herein include double- and singlestranded DNA and/or RNA. They also include known types of modifications, for example, methylation, "caps", substitutions of one or more of the naturally occurring nucleotides with an analog. Preferably, the DNA or RNA sequence comprises a coding sequence encoding the herein defined polypeptide.

A "coding sequence" is a nucleotide sequence, which is transcribed into an RNA, e.g. a regulatory RNA, such as a miRNA, a ta-siRNA, cosuppression molecule, an RNAi, a ribozyme, etc. or into a mRNA which is translated into a polypeptide when placed under the control of appropriate regulatory sequences. The boundaries of the coding sequence are determined by a translation start codon at the 5'-terminus and a translation stop codon at the 3'-terminus. The triplets taa, tga and tag represent the (usual) stop codons which are interchangeable. A coding sequence can include, but is not limited to mRNA, cDNA, recombinant nucleotide sequences or genomic DNA, while introns may be present as well under certain circumstances.

As used in the present context a nucleic acid molecule may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. In the event for example the antisense, RNAi, snRNA, dsRNA, siRNA, miRNA, ta-siRNA, cosuppression molecule, ribozyme etc. technology is used coding regions as well as the 5'- and/or 3'-regions can advantageously be used. However, it is often advantageous only to choose the coding region for cloning and expression purposes.

"Polypeptide" refers to a polymer of amino acid (amino acid sequence) and does not refer to a specific length of the molecule. Thus, peptides and oligopeptides are included within the definition of polypeptide. This term does also refer to or include post-translational modifications of the polypeptide, for example, glycosylations, acetylations, phosphorylations and the like. Included within the definition are, for example, polypeptides containing one or more analogs of an amino acid (including, for example, unnatural amino acids, etc.), polypeptides with substituted linkages, as well as other modifications known in the art, both naturally occurring and non-naturally occurring.

The term "table I" used in this specification is to be taken to specify the content of table I A and table I B. The term "table II" used in this specification is to be taken to specify the content of table II A and table II B. The term "table I A" used in this specification is to be taken to specify the content of table I A. The term "table I B" used in this specification is to be taken to specify the content of table I B. The term "table II A" used in this specification is to be taken to specify the content of table II A. The term "table II B" used in this specification is to be taken to specify the content of table II B. In one preferred embodiment, the term "table I" means table I B. In one preferred embodiment, the term "table II" means table II B.

The terms "comprise" or "comprising" and grammatical variations thereof when used in this specification are to be taken to specify the presence of stated features, integers, steps or components or groups thereof, but not to preclude the presence or addition of one or more other features, integers, steps, components or groups thereof.

In accordance with the invention, a protein or polypeptide has the "activity of an protein as shown in table II, column 3" if its de novo activity, or its increased expression directly or indirectly leads to and confers an increased yield, especially an enhanced NUE and/or increased biomass production, as compared to a corresponding non-transformed wild type plant cell, plant or part thereof and the protein has the above mentioned activities of a protein as shown in table II, column 3.

Throughout the specification the activity or preferably the biological activity of such a protein or polypeptide or an nucleic acid molecule or sequence encoding such protein or polypeptide is identical or similar if it still has the biological or enzymatic activity of a protein as shown in table II, column 3, or which has at least 10% of the original enzymatic activity, preferably 20%, 30%, 40%, 50%, particularly preferably 60%, 70%, 80% most particularly preferably 90%, 95%, 98%, 99% in comparison to a protein as shown in table II, column 3 of *E. coli* or *Saccharomyces cerevisiae*. In another embodiment the biological or enzymatic activity of a protein as shown in table II, column 3, has at least 101% of the original enzymatic activity, preferably 110%, 120%, %, 150%, particularly preferably 150%, 200%, 300% in comparison to a protein as shown in table II, column 3 of *E. coli* or *Saccharomyces cerevisiae*.

The terms "increased", "raised", "extended", "enhanced", "improved" or "amplified" relate to a corresponding change of a property in a plant, an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced.

The terms "increase" relate to a corresponding change of a property an organism or in a part of a plant, an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" include the change of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Accordingly, the term "increase" means that the specific activity of an enzyme as well as the amount of a compound or metabolite, e.g. of a polypeptide, a nucleic acid molecule of the invention or an encoding mRNA or DNA, can be increased in a volume.

The terms "wild type", "control" or "reference" are exchangeable and can be a cell or a part of organisms such as an organelle like a chloroplast or a tissue, or an organism, in particular a plant, which was not modified or treated according to the herein described process according to the invention. Accordingly, the cell or a part of organisms such as an organelle like a chloroplast or a tissue, or an organism, in particular a plant used as wild type, control or reference corresponds to the cell, organism, plant or part thereof as much as possible and is in any other property but in the result of the process of the invention as identical to the subject matter of the invention as possible. Thus, the wild type, control or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, soil, nutrient, water content of the soil, temperature, humidity or surrounding air or soil, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant, which was not modified or treated according to the herein described process of the invention and is in any other property as similar to the subject matter of the invention as possible. The reference, control or wild type is in its genome, transcriptome, proteome or metabolome as similar as possible to the subject of the present invention. Preferably, the term "reference-" "control-" or "wild type-"-organelle, -cell, -tissue or -organism, in particular plant, relates to an organelle, cell, tissue or organism, in particular plant, which is nearly genetically identical to the organelle, cell, tissue or organism, in particular plant, of the present invention or a part thereof preferably 95%, more preferred are 98%, even more preferred are 99.00%, in particular 99.10%, 99.30%, 99.50%, 99.70%, 99.90%, 99.99%, 99.999% or more. Most preferable the "reference", "control", or "wild type" is a subject, e.g. an organelle, a cell, a tissue, an organism, in particular a plant, which is genetically identical to the organism, in particular plant, cell, a tissue or organelle used according to the process of the invention except that the responsible or activity conferring nucleic acid molecules or the gene product encoded by them are amended, manipulated, exchanged or introduced according to the inventive process.

In case, a control, reference or wild type differing from the subject of the present invention only by not being subject of the process of the invention can not be provided, a control, reference or wild type can be an organism in which the cause for the modulation of an activity conferring the enhanced NUE and/or increased biomass production for example as compared to a corresponding non-transformed wild type plant cell, plant or part thereof or expression of the nucleic acid molecule of the invention as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or protein or activity or expression of reference genes, like housekeeping genes, such as ubiquitin, actin or ribosomal proteins.

The increase or modulation according to this invention can be constitutive, e.g. due to a stable permanent transgenic expression or to a stable mutation in the corresponding endogenous gene encoding the nucleic acid molecule of the invention or to a modulation of the expression or of the behavior of a gene conferring the expression of the polypeptide of the invention, or transient, e.g. due to an transient transformation or temporary addition of a modulator such as a agonist or antagonist or inducible, e.g. after transformation with a inducible construct carrying the nucleic acid molecule of the invention under control of a inducible promoter and adding the inducer, e.g. tetracycline or as described herein below.

The increase in activity of the polypeptide amounts in a cell, a tissue, an organelle, an organ or an organism, preferably a plant, or a part thereof preferably to at least 5%, preferably to at least 20% or at to least 50%, especially preferably to at least 70%, 80%, 90% or more, very especially preferably are to at least 100%, 150% or 200%, most preferably are to at least 250% or more in comparison to the control, reference or wild type.

In one embodiment the term increase means the increase in amount in relation to the weight of the organism or part thereof (w/w).

In one embodiment the increase in activity of the polypeptide amounts in an organelle such as a plastid.

In another embodiment the increase in activity of the polypeptide amounts in the cytosol.

The specific activity of a polypeptide encoded by a nucleic acid molecule of the present invention or of the polypeptide of the present invention can be tested as described in the examples. In particular, the expression of a protein in question in a cell, e.g. a plant cell in comparison to a control is an easy test and can be performed as described in the state of the art.

The term "increase" includes, that a compound or an activity, especially an activity, is introduced into a cell, the cytosol or a subcellular compartment or organelle de novo or that the compound or the activity, especially an activity, has not been detected before, in other words it is "generated".

Accordingly, in the following, the term "increasing" also comprises the term "generating" or "stimulating". The increased activity manifests itself in an increased yield, especially an enhanced NUE and/or increased biomass production, as compared to a corresponding non-transformed wild type plant cell, plant or part thereof.

The sequence of B0017 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as b0017-protein.

Accordingly, in one embodiment, the process of the present invention comprises increasing or generating the activity of a gene product with the activity of a "b0017-protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B0017 or a functional equivalent or a homologue thereof as shown in column 7 of table I, application no. 1, preferably a homologue or functional equivalent as shown in column 7 of table I B, application no. 1, and being depicted in the same respective line as said B0017; or
(b) a polypeptide comprising a polypeptide, a consensus sequence or a polypeptide motif as shown n column 5 of table II or in column 7 of table IV, application no. 1, respectively, and being depicted in the same respective line as said B0017 or a functional equivalent or a homologue thereof as depicted in column 7 of table II, application no. 1, preferably a homologue or functional equivalent as depicted in column 7 of table II B, application no. 1, and being depicted in the same respective line as said B0017,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "b0017-protein", preferably it is the molecule of section (a) or (b) of this paragraph.

In one embodiment, said molecule, which activity is to be increased in the process of the invention and which is the gene product with an activity as described as a "b0017-protein", is increased cytoplasmic.

The sequence of B0045 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as transport protein.

Accordingly, in one embodiment, the process of the present invention comprises increasing or generating the activity of a gene product with the activity of a "transport protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B0045 or a functional equivalent or a homologue thereof as shown in column 7 of table I, application no. 1, preferably a homologue or functional equivalent as shown in column 7 of table I B, application no. 1, and being depicted in the same respective line as said B0045; or
(b) a polypeptide comprising a polypeptide, a consensus sequence or a polypeptide motif as shown in column 5 of table II or in column 7 of table IV, application no. 1, respectively, and being depicted in the same respective line as said B0045 or a functional equivalent or a homologue thereof as depicted in column 7 of table II, application no. 1, preferably a homologue or functional equivalent as depicted in column 7 of table II B, application no. 1, and being depicted in the same respective line as said B0045,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "transport protein", preferably it is the molecule of section (a) or (b) of this paragraph.

In embodiment, said molecule, which activity is to be increased in the process of the invention and which is the gene product with an activity as described as a "transport protein", is increased cytoplasmic.

The sequence of B0180 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as hydroxymyristol acyl carrier protein dehydratase.

Accordingly, in one embodiment, the process of the present invention comprises increasing or generating the activity of a gene product with the activity of a "hydroxymyristol acyl carrier protein dehydratase" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B0180 or a functional equivalent or a homologue thereof as shown in column 7 of table I, application no. 1, preferably a homologue or functional equivalent as shown in column 7 of table I B, application no. 1, and being depicted in the same respective line as said B0180; or
(b) a polypeptide comprising a polypeptide, a consensus sequence or a polypeptide motif as shown in column 5 of table II or in column 7 of table IV, application no. 1, respectively, and being depicted in the same respective line as said B0180 or a functional equivalent or a homologue thereof as depicted in column 7 of table II, application no. 1, preferably a homologue or functional equivalent as depicted in column 7 of table II B, application no. 1, and being depicted in the same respective line as said B0180,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "hydroxymyristol acyl carrier protein dehydratase", preferably it is the molecule of section (a) or (b) of this paragraph.

In one embodiment, said molecule, which activity is to be increased in the process of the invention and which is the gene product with an activity as described as a "hydroxymyristol acyl carrier protein dehydratase", is increased plastidic.

The sequence of B0242 from *Escherichia coli* K12, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as gamma-glutamyl kinase.

Accordingly, in one embodiment, the process of the present invention comprises increasing or generating the activity of a gene product with the activity of a "gamma-glutamyl kinase" from *Escherichia coli* K12 or its functional equivalent or its homolog, e.g. the increase of
(a) a gene product of a gene comprising the nucleic acid molecule as shown in column 5 of table I, application no. 1, and being depicted in the same respective line as said B0242 or a functional equivalent or a homologue thereof as shown in column 7 of table I, application no. 1, preferably a homologue or functional equivalent as shown in column 7 of table I B, application no. 1, and being depicted in the same respective line as said B0242; or
(b) a polypeptide comprising a polypeptide, a consensus sequence or a polypeptide motif as shown in column 5 of table II or in column 7 of table IV, application no. 1, respectively, and being depicted in the same respective line as said B0242 or a functional equivalent or a homologue thereof as depicted in column 7 of table II, application no. 1, preferably a homologue or functional equivalent as depicted in column 7 of table II B, application no. 1, and being depicted in the same respective line as said B0242,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "gamma-glutamyl kinase", preferably it is the molecule of section (a) or (b) of this paragraph.

In one embodiment, said molecule, which activity is to be increased in the process of the invention and which is the gene product with an activity as described as a "gamma-glutamyl kinase", is increased plastidic.

The sequence of B0403 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as alpha-glucosidase.

Accordingly, in one embodiment, the process of the present invention comprises increasing or generating the activity of a gene product with the activity of a "alpha-glucosidase" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B0403 or a functional equivalent or a homologue thereof as shown in column 7 of table I, application no. 1, preferably a homologue or functional equivalent as shown in column 7 of table I B, application no. 1, and being depicted in the same respective line as said B0403; or
(b) a polypeptide comprising a polypeptide, a consensus sequence or a polypeptide motif as shown in column 5 of table II or in column 7 of table IV, application no. 1, respectively, and being depicted in the same respective line as said B0403 or a functional equivalent or a homologue thereof as depicted in column 7 of table II, application no. 1, preferably a homologue or functional equivalent as depicted in column 7 of table II B, application no. 1, and being depicted in the same respective line as said B0403,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "alpha-glucosidase", preferably it is the molecule of section (a) or (b) of this paragraph.

In one embodiment, said molecule, which activity is to be increased in the process of the invention and which is the gene product with an activity as described as a "alpha-glucosidase", is increased plastidic.

The sequence of B0474 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as adenylate kinase.

Accordingly, in one embodiment, the process of the present invention comprises increasing or generating the activity of a gene product with the activity of a "adenylate kinase" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B0474 or a functional equivalent or a homologue thereof as shown in column 7 of table I, application no. 1, preferably a homologue or functional equivalent as shown in column 7 of table I B, application no. 1, and being depicted in the same respective line as said B0474; or
(b) a polypeptide comprising a polypeptide, a consensus sequence or a polypeptide motif as shown in column 5 of table II or in column 7 of table IV, application no. 1, respectively, and being depicted in the same respective line as said B0474 or a functional equivalent or a homologue thereof as depicted in column 7 of table II, application no. 1, preferably a homologue or functional equivalent as depicted in column 7 of table II B, application no. 1, and being depicted in the same respective line as said B0474,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "adenylate kinase", preferably it is the molecule of section (a) or (b) of this paragraph.

In one embodiment, said molecule, which activity is to be increased in the process of the invention and which is the gene product with an activity as described as a "adenylate kinase", is increased cytoplasmic.

The sequence of B0754 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as 2-dehydro-3-deoxy-phosphoheptonate aldolase.

Accordingly, in one embodiment, the process of the present invention comprises increasing or generating the activity of a gene product with the activity of a "2-dehydro-3-deoxy-phosphoheptonate aldolase" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B0754 or a functional equivalent or a homologue thereof as shown in column 7 of table I, application no. 1, preferably a homologue or functional equivalent as shown in column 7 of table I B, application no. 1, and being depicted in the same respective line as said B0754; or
(b) a polypeptide comprising a polypeptide, a consensus sequence or a polypeptide motif as shown in column 5 of table II or in column 7 of table IV, application no. 1, respectively, and being depicted in the same respective line as said B0754 or a functional equivalent or a homologue thereof as depicted in column 7 of table II, application no. 1, preferably a homologue or functional equivalent as depicted in column 7 of table II B, application no. 1, and being depicted in the same respective line as said B0754,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "2-dehydro-3-deoxy-phosphoheptonate aldolase", preferably it is the molecule of section (a) or (b) of this paragraph.

In one embodiment, said molecule, which activity is to be increased in the process of the invention and which is the gene product with an activity as described as a "2-dehydro-3-deoxy-phosphoheptonate aldolase", is increased plastidic.

The sequence of B0784 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as molybdopterin biosynthesis protein.

Accordingly, in one embodiment, the process of the present invention comprises increasing or generating the activity of a gene product with the activity of a "molybdopterin biosynthesis protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B0784 or a functional equivalent or a homologue thereof as shown in column 7 of table I, application no. 1, preferably a homologue or functional equivalent as shown in column 7 of table I B, application no. 1, and being depicted in the same respective line as said B0784; or
(b) a polypeptide comprising a polypeptide, a consensus sequence or a polypeptide motif as shown in column 5 of table II or in column 7 of table IV, application no. 1, respectively, and being depicted in the same respective line as said B0784 or a functional equivalent or a homologue thereof as depicted in column 7 of table II, application no. 1, preferably a homologue or functional equivalent as depicted in column 7 of table II B, application no. 1, and being depicted in the same respective line as said B0784,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "molybdopterin biosynthesis protein", preferably it is the molecule of section (a) or (b) of this paragraph.

In one embodiment, said molecule, which activity is to be increased in the process of the invention and which is the gene product with an activity as described as a "molybdopterin biosynthesis protein", is increased cytoplasmic.

The sequence of B0873 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as hydroxylamine reductase.

Accordingly, in one embodiment, the process of the present invention comprises increasing or generating the activity of a gene product with the activity of a "hydroxylamine reductase" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B0873 or a functional equivalent or a homologue thereof as shown in column 7 of table I, application no. 1, preferably a homologue or functional equivalent as shown in column 7 of table I B, application no. 1, and being depicted in the same respective line as said B0873; or
(b) a polypeptide comprising a polypeptide, a consensus sequence or a polypeptide motif as shown in column 5 of table II or in column 7 of table IV, application no. 1, respectively, and being depicted in the same respective line as said B0873 or a functional equivalent or a homologue thereof as depicted in column 7 of table II, application no. 1, preferably a homologue or functional equivalent as depicted in column 7 of table II B, application no. 1, and being depicted in the same respective line as said B0873,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "hydroxylamine reductase", preferably it is the molecule of section (a) or (b) of this paragraph.

In one embodiment, said molecule, which activity is to be increased in the process of the invention and which is the gene product with an activity as described as a "hydroxylamine reductase", is increased plastidic.

The sequence of B1014 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as proline dehydrogenase.

Accordingly, in one embodiment, the process of the present invention comprises increasing or generating the activity of a gene product with the activity of a "proline dehydrogenase" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B1014 or a functional equivalent or a homologue thereof as shown in column 7 of table I, application no. 1, preferably a homologue or functional equivalent as shown in column 7 of table I B, application no. 1, and being depicted in the same respective line as said B1014; or
(b) a polypeptide comprising a polypeptide, a consensus sequence or a polypeptide motif as shown in column 5 of table II or in column 7 of table IV, application no. 1, respectively, and being depicted in the same respective line as said B1014 or a functional equivalent or a homologue thereof as depicted in column 7 of table II, application no. 1, preferably a homologue or functional equivalent as depicted in column 7 of table II B, application no. 1, and being depicted in the same respective line as said B1014, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "proline dehydrogenase", preferably it is the molecule of section (a) or (b) of this paragraph.

In one embodiment, said molecule, which activity is to be increased in the process of the invention and which is the gene product with an activity as described as a "proline dehydrogenase", is increased cytoplasmic.

The sequence of B1020 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as PhoH-like protein.

Accordingly, in one embodiment, the process of the present invention comprises increasing or generating the activity of a gene product with the activity of a "PhoH-like protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B1020 or a functional equivalent or a homologue thereof as shown in column 7 of table I, application no. 1, preferably a homologue or functional equivalent as shown in column 7 of table I B, application no. 1, and being depicted in the same respective line as said B1020; or
(b) a polypeptide comprising a polypeptide, a consensus sequence or a polypeptide motif as shown in column 5 of table II or in column 7 of table IV, application no. 1, respectively, and being depicted in the same respective line as said B1020 or a functional equivalent or a homologue thereof as depicted in column 7 of table II, application no. 1, preferably a homologue or functional equivalent as depicted in column 7 of table II B, application no. 1, and being depicted in the same respective line as said B1020, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "PhoH-like protein", preferably it is the molecule of section (a) or (b) of this paragraph.

In one embodiment, said molecule, which activity is to be increased in the process of the invention and which is the gene product with an activity as described as a "PhoHlike protein", is increased plastidic.

The sequence of B1180 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as isomerase.

Accordingly, in one embodiment, the process of the present invention comprises increasing or generating the activity of a gene product with the activity of a "isomerase" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B1180 or a functional equivalent or a homologue thereof as shown in column 7 of table I, application no. 1, preferably a homologue or functional equivalent as shown in column 7 of table I B, application no. 1, and being depicted in the same respective line as said B1180; or
(b) a polypeptide comprising a polypeptide, a consensus sequence or a polypeptide motif as shown in column 5 of table II or in column 7 of table IV, application no. 1, respectively, and being depicted in the same respective line as said B1180 or a functional equivalent or a homologue thereof as depicted in column 7 of table II, application no. 1, preferably a homologue or functional equivalent as depicted in column 7 of table II B, application no. 1, and being depicted in the same respective line as said B1180, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "isomerase", preferably it is the molecule of section (a) or (b) of this paragraph.

In one embodiment, said molecule, which activity is to be increased in the process of the invention and which is the gene product with an activity as described as a "isomerase", is increased cytoplasmic.

The sequence of B1933 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as b1933-protein.

Accordingly, in one embodiment, the process of the present invention comprises increasing or generating the activity of a gene product with the activity of a "b1933-protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B1933 or a functional equivalent or a homologue thereof as shown in column 7 of table I, application no. 1, preferably a homologue or functional equivalent as shown in column 7 of table I B, application no. 1, and being depicted in the same respective line as said B1933; or
(b) a polypeptide comprising a polypeptide, a consensus sequence or a polypeptide motif as shown in column 5 of table II or in column 7 of table IV, application no. 1, respectively, and being depicted in the same respective line as said B1933 or a functional equivalent or a homologue thereof as depicted in column 7 of table II, application no. 1, preferably a homologue or functional equivalent as depicted in column 7 of table II B, application no. 1, and being depicted in the same respective line as said B1933, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "b1933-protein", preferably it is the molecule of section (a) or (b) of this paragraph.

In one embodiment, said molecule, which activity is to be increased in the process of the invention and which is the gene product with an activity as described as a "b1933-protein", is increased plastidic.

The sequence of B2032 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as glycosyltransferase.

Accordingly, in one embodiment, the process of the present invention comprises increasing or generating the activity of a gene product with the activity of a "glycosyltransferase" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B2032 or a functional equivalent or a homologue thereof as shown in column 7 of table I, application no. 1, preferably a homologue or functional equivalent as shown in column 7 of table I B, application no. 1, and being depicted in the same respective line as said B2032; or
(b) a polypeptide comprising a polypeptide, a consensus sequence or a polypeptide motif as shown in column 5 of table II or in column 7 of table IV, application no. 1, respectively, and being depicted in the same respective line as said B2032 or a functional equivalent or a homologue thereof as depicted in column 7 of table II, application no. 1, preferably a homologue or functional equivalent as depicted in column 7 of table II B, application no. 1, and being depicted in the same respective line as said B2032, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "glycosyltransferase", preferably it is the molecule of section (a) or (b) of this paragraph.

In one embodiment, said molecule, which activity is to be increased in the process of the invention and which is the gene product with an activity as described as a "glycosyltransferase", is increased plastidic.

The sequence of B2165 from *Escherichia coli* K12, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as b2165-protein.

Accordingly, in one embodiment, the process of the present invention comprises increasing or generating the activity of a gene product with the activity of a "b2165-protein" from *Escherichia coli* K12 or its functional equivalent or its homolog, e.g. the increase of
(a) a gene product of a gene comprising the nucleic acid molecule as shown in column 5 of table I, application no. 1, and being depicted in the same respective line as said B2165 or a functional equivalent or a homologue thereof as shown in column 7 of table I, application no. 1, preferably a homologue or functional equivalent as shown in column 7 of table I B, application no. 1, and being depicted in the same respective line as said B2165; or
(b) a polypeptide comprising a polypeptide, a consensus sequence or a polypeptide motif as shown in column 5 of table II or in column 7 of table IV, application no. 1, respectively, and being depicted in the same respective line as said B2165 or a functional equivalent or a homologue thereof as depicted in column 7 of table II, application no. 1, preferably a homologue or functional equivalent as depicted in column 7 of table II B, application no. 1, and being depicted in the same respective line as said B2165, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "b2165-protein", preferably it is the molecule of section (a) or (b) of this paragraph.

In one embodiment, said molecule, which activity is to be increased in the process of the invention and which is the gene product with an activity as described as a "b2165-protein", is increased plastidic.

The sequence of B2223 from *Escherichia coli* K12, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as short chain fatty acid transporter.

Accordingly, in one embodiment, the process of the present invention comprises increasing or generating the activity of a gene product with the activity of a "short chain fatty acid transporter" from *Escherichia coli* K12 or its functional equivalent or its homolog, e.g. the increase of (a) a gene product of a gene comprising the nucleic acid molecule as shown in column 5 of table I, application no. 1, and being depicted in the same respective line as said B2223 or a functional equivalent or a homologue thereof as shown in column 7 of table I, application no. 1, preferably a homologue or functional equivalent as shown in column 7 of table I B, application no. 1, and being depicted in the same respective line as said B2223; or (b) a polypeptide comprising a polypeptide, a consensus sequence or a polypeptide motif as shown in column 5 of table II or in column 7 of table IV, application no. 1, respectively, and being depicted in the same respective line as said B2223 or a functional equivalent or a homologue thereof as depicted in column 7 of table II, application no. 1, preferably a homologue or functional equivalent as depicted in column 7 of table II B, application no. 1, and being depicted in the same respective line as said B2223, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "short chain fatty acid transporter", preferably it is the molecule of section (a) or (b) of this paragraph.

In one embodiment, said molecule, which activity is to be increased in the process of the invention and which is the gene product with an activity as described as a "short chain fatty acid transporter", is increased plastidic.

The sequence of B2238 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as b2238-protein.

Accordingly, in one embodiment, the process of the present invention comprises increasing or generating the activity of a gene product with the activity of a "b2238-protein" from *Escherichia coli* or its functional equivalent or its homolog, e.g. the increase of (a) a gene product of a gene comprising the nucleic acid molecule as shown in column 5 of table I, application no. 1, and being depicted in the same respective line as said B2238 or a functional equivalent or a homologue thereof as shown in column 7 of table I, application no. 1, preferably a homologue or functional equivalent as shown in column 7 of table I B, application no. 1, and being depicted in the same respective line as said B2238; or (b) a polypeptide comprising a polypeptide, a consensus sequence or a polypeptide motif as shown in column 5 of table II or in column 7 of table IV, application no. 1, respectively, and being depicted in the same respective line as said B2238 or a functional equivalent or a homologue thereof as depicted in column 7 of table II, application no. 1, preferably a homologue or functional equivalent as depicted in column 7 of table II B, application no. 1, and being depicted in the same respective line as said B2238, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "b2238-protein", preferably it is the molecule of section (a) or (b) of this paragraph.

In one embodiment, said molecule, which activity is to be increased in the process of the invention and which is the gene product with an activity as described as a "b2238-protein", is increased plastidic.

In another embodiment, said molecule, which activity is to be increased in the process of the invention and which is the gene product with an activity as described as a "b2238-protein", is increased cytoplasmic.

The sequence of B2310 from *Escherichia coli* K12, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as lysine/arginine/ornithine transporter subunit.

Accordingly, in one embodiment, the process of the present invention comprises increasing or generating the activity of a gene product with the activity of a "lysine/arginine/ornithine transporter subunit" from *Escherichia coli* K12 or its functional equivalent or its homolog, e.g. the increase of (a) a gene product of a gene comprising the nucleic acid molecule as shown in column 5 of table I, application no. 1, and being depicted in the same respective line as said B2310 or a functional equivalent or a homologue thereof as shown in column 7 of table I, application no. 1, preferably a homologue or functional equivalent as shown in column 7 of table I B, application no. 1, and being depicted in the same respective line as said B2310; or (b) a polypeptide comprising a polypeptide, a consensus sequence or a polypeptide motif as shown in column 5 of table II or in column 7 of table IV, application no. 1, respectively, and being depicted in the same respective line as said B2310 or a functional equivalent or a homologue thereof as depicted in column 7 of table II, application no. 1, preferably a homologue or functional equivalent as depicted in column 7 of table II B, application no. 1, and being depicted in the same respective line as said B2310, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "lysine/arginine/ornithine transporter subunit", preferably it is the molecule of section (a) or (b) of this paragraph.

In one embodiment, said molecule, which activity is to be increased in the process of the invention and which is the gene product with an activity as described as a "lysine/arginine/ornithine transporter subunit", is increased plastidic.

The sequence of B2431 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as b2431-protein.

Accordingly, in one embodiment, the process of the present invention comprises increasing or generating the activity of a gene product with the activity of a "b2431-protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B2431 or a functional equivalent or a homologue thereof as shown in column 7 of table I, application no. 1, preferably a homologue or functional equivalent as shownin column 7 of table I B, application no. 1, and being depicted in the same respective line as said B2431; or
(b) a polypeptide comprising a polypeptide, a consensus sequence or a polypeptide motif as shown in column 5 of table II or in column 7 of table IV, application no. 1, respectively, and being depicted in the same respective line as said B2431 or a functional equivalent or a homologue thereof as depicted in column 7 of table II, application no. 1, preferably a homologue or functional equivalent as depicted in column 7 of table II B, application no. 1, and being depicted in the same respective line as said B2431, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "b2431-protein", preferably it is the molecule of section (a) or (b) of this paragraph.

In one embodiment, said molecule, which activity is to be increased in the process of the invention and which is the gene product with an activity as described as a "b2431-protein", is increased plastidic.

The sequence of B2600 from *Escherichia coli* K12, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as chorismate mutase T/prephenate dehydrogenase (bifunctional).

Accordingly, in one embodiment, the process of the present invention comprises increasing or generating the activity of a gene product with the activity of a "chorismate mutase T/prephenate dehydrogenase (bifunctional)" from *Escherichia coli* K12 or its functional equivalent or its homolog, e.g. the increase of
(a) a gene product of a gene comprising the nucleic acid molecule as shown in column 5 of table I, application no. 1, and being depicted in the same respective line as said B2600 or a functional equivalent or a homologue thereof as shown in column 7 of table I, application no. 1, preferably a homologue or functional equivalent as shown in column 7 of table I B, application no. 1, and being depicted in the same respective line as said B2600; or
(b) a polypeptide comprising a polypeptide, a consensus sequence or a polypeptide motif as shown in column 5 of table II or in column 7 of table IV, application no. 1, respectively, and being depicted in the same respective line as said B2600 or a functional equivalent or a homologue thereof as depicted in column 7 of table II, application no. 1, preferably a homologue or functional equivalent as depicted in column 7 of table II B, application no. 1, and being depicted in the same respective line as said B2600, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "chorismate mutase T/prephenate dehydrogenase (bifunctional)", preferably it is the molecule of section (a) or (b) of this paragraph.

In one embodiment, said molecule, which activity is to be increased in the process of the invention and which is the gene product with an activity as described as a "chorismate mutase T/prephenate dehydrogenase (bifunctional)", is increased plastidic.

The sequence of B2766 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as b2766-protein.

Accordingly, in one embodiment, the process of the present invention comprises increasing or generating the activity of a gene product with the activity of a "b2766-protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B2766 or a functional equivalent or a homologue thereof as shown in column 7 of table I, application no. 1, preferably a homologue or functional equivalent as shown in column 7 of table I B, application no. 1, and being depicted in the same respective line as said B2766; or (b) a polypeptide comprising a polypeptide, a consensus sequence or a polypeptide motif as shown in column 5 of table II or in column 7 of table IV, application no. 1, respectively, and being depicted in the same respective line as said B2766 or a functional equivalent or a homologue thereof as depicted in column 7 of table II, application no. 1, preferably a homologue or functional equivalent as depicted in column 7 of table II B, application no. 1, and being depicted in the same respective line as said B2766, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "b2766-protein", preferably it is the molecule of section (a) or (b) of this paragraph.

In one embodiment, said molecule, which activity is to be increased in the process of the invention and which is the gene product with an activity as described as a "b2766-protein", is increased plastidic.

The sequence of B2903 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as glycine decarboxylase.

Accordingly, in one embodiment, the process of the present invention comprises increasing or generating the activity of a gene product with the activity of a "glycine decarboxylase" from *Escherichia coli* or its functional equivalent or its homolog, e.g. the increase of (a) a gene product of a gene comprising the nucleic acid molecule as shown in column 5 of table I, application no. 1, and being depicted in the same respective line as said B2903 or a functional equivalent or a homologue thereof as shown in column 7 of table I, application no. 1, preferably a homologue or functional equivalent as shown in column 7 of table I B, application no. 1, and being depicted in the same respective line as said B2903; or (b) a polypeptide comprising a polypeptide, a consensus sequence or a polypeptide motif as shownin column 5 of table II or in column 7 of table IV, application no. 1, respectively, and being depicted in the same respective line as said B2903 or a functional equivalent or a homologue thereof as depicted in column 7 of table II, application no. 1, preferably a homologue or functional equivalent as depicted in column 7 of table II B, application no. 1, and being depicted in the same respective line as said B2903, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "glycine decarboxylase", preferably it is the molecule of section (a) or (b) of this paragraph.

In one embodiment, said molecule, which activity is to be increased in the process of the invention and which is the gene product with an activity as described as a "glycine decarboxylase", is increased cytoplasmic.

The sequence of B3117 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as threonine ammonia-lyase.

Accordingly, in one embodiment, the process of the present invention comprises increasing or generating the activity of a gene product with the activity of a "threonine ammonia-lyase" from *Escherichia coli* or its functional equivalent or its homolog, e.g. the increase of (a) a gene product of a gene comprising the nucleic acid molecule as shown in column 5 of table I, application no. 1, and being depicted in the same respective line as said B3117 or a functional equivalent or a homologue thereof as shown in column 7 of table I, application no. 1, preferably a homologue or functional equivalent as shown in column 7 of table I B, application no. 1, and being depicted in the same respective line as said B3117; or (b) a polypeptide comprising a polypeptide, a consensus sequence or a polypeptide motif as shown in column 5 of table II or in column 7 of table IV, application no. 1, respectively, and being depicted in the same respective line as said B3117 or a functional equivalent or a homologue thereof as depicted in column 7 of table II, application no. 1, preferably a homologue or functional equivalent as depicted in column 7 of table II B, application no. 1, and being depicted in the same respective line as said B3117, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "threonine ammonia-lyase", preferably it is the molecule of section (a) or (b) of this paragraph.

In one embodiment, said molecule, which activity is to be increased in the process of the invention and which is the gene product with an activity as described as a "threonine ammonia-lyase", is increased plastidic.

The sequence of B3120 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as b3120-protein.

Accordingly, in one embodiment, the process of the present invention comprises increasing or generating the activity of a gene product with the activity of a "b3120-protein" from *Escherichia coli* or its functional equivalent or its homolog, e.g. the increase of (a) a gene product of a gene comprising the nucleic acid molecule as shown in column 5 of table I, application no. 1, and being depicted in the same respective line as said B3120 or a functional equivalent or a homologue thereof as shown in column 7 of table I, application no. 1, preferably a homologue or functional equivalent as shown in column 7 of table I B, application no. 1, and being depicted in the same respective line as said B3120; or (b) a polypeptide comprising a polypeptide, a consensus sequence or a polypeptide motif as shown in column 5 of table II or in column 7 of table IV, application no. 1, respectively, and being depicted in the same respective line as said B3120 or a functional equivalent or a homologue thereof as depicted in column 7 of table II, application no. 1, preferably a homologue or functional equivalent as depicted in column 7 of table II B, application no. 1, and being depicted in the same respective line as said B3120, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "b3120-protein", preferably it is the molecule of section (a) or (b) of this paragraph.

In one embodiment, said molecule, which activity is to be increased in the process of the invention and which is the gene product with an activity as described as a "b3120-protein", is increased plastidic.

The sequence of B3216 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as outer membrane usher protein.

Accordingly, in one embodiment, the process of the present invention comprises increasing or generating the activity of a gene product with the activity of a "outer membrane usher protein" from *Escherichia coli* or its functional equivalent or its homolog, e.g. the increase of (a) a gene product of a gene comprising the nucleic acid molecule as shown in column 5 of table I, application no. 1, and being depicted in the same respective line as said B3216 or a functional equivalent or a homologue thereof as shown in column 7 of table I, application no. 1, preferably a homologue or functional equivalent as shown in column 7 of table I B, application no. 1, and being depicted in the same respective line as said B3216; or (b) a polypeptide comprising a polypeptide, a consensus sequence or a polypeptide motif as shown in column 5 of table II or in column 7 of table IV, application no. 1, respectively, and being depicted in the same respective line as said B3216 or a functional equivalent or a homologue thereof as depicted in column 7 of table II, application no. 1, preferably a homologue or functional equivalent as depicted in column 7 of table II B, application no. 1, and being depicted in the same respective line as said B3216, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "outer membrane usher protein", preferably it is the molecule of section (a) or (b) of this paragraph.

In one embodiment, said molecule, which activity is to be increased in the process of the invention and which is the gene product with an activity as described as a "outer membrane usher protein", is increased plastidic.

The sequence of B3451 from *Escherichia coli* K12, e.g. as shown in column 5 of table I, application no. 1, is published (e.g. sequences from *Saccharomyces cerevisiae* have been published in Goffeau et al., Science 274 (5287), 546 (1996), sequences from Escherichia coli have been published in Blattner et al., Science 277 (5331), 1453 (1997)), and/or its activity is described as glycerol-3-phosphate transporter subunit.

Accordingly, in one embodiment, the process of the present invention comprises increasing or generating the activity of a gene product with the activity of a "glycerol-3-phosphate transporter subunit" from *Escherichia coli* K12 or its functional equivalent or its homolog, e.g. the increase of (a) a gene product of a gene comprising the nucleic acid molecule as shown in column 5 of table I, application no. 1, and being depicted in the same respective line as said B3451 or a functional equivalent or a homologue thereof as shown in column 7 of table I, application no. 1, preferably a homologue or functional equivalent as shown in column 7 of table I B, application no. 1, and being depicted in the same respective line as said B3451; or (b) a polypeptide comprising a polypeptide, a consensus sequence or a polypeptide motif as shown in column 5 of table II or in column 7 of table IV, application no. 1, respectively, and being depicted in the same respective line as said B3451 or a functional equivalent or a homologue thereof as depicted in column 7 of table II, application no. 1, preferably a homologue or functional equivalent as depicted in column 7 of table II B, application no. 1, and being depicted in the same respective line as said B3451, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "glycerol-3-phosphate transporter subunit", preferably it is the molecule of section (a) or (b) of this paragraph.

In one embodiment, said molecule, which activity is to be increased in the process of the invention and which is the gene product with an activity as described as a "glycerol-3-phosphate transporter subunit", is increased plastidic.

The sequence of B3791 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as hydro-lyase.

Accordingly, in one embodiment, the process of the present invention comprises increasing or generating the activity of a gene product with the activity of a "hydro-lyase" from *Escherichia coli* or its functional equivalent or its homolog, e.g. the increase of (a) a gene product of a gene comprising the nucleic acid molecule as shown in column 5 of table I, application no. 1, and being depicted in the same respective line as said B3791 or a functional equivalent or a homologue thereof as shown in column 7 of table I, application no. 1, preferably a homologue or functional equivalent as shown in column 7 of table I B, application no. 1, and being depicted in the same respective line as said B3791; or (b) a polypeptide comprising a polypeptide, a consensus sequence or a polypeptide motif as shown in column 5 of table II or in column 7 of table IV, application no. 1, respectively, and being depicted in the same respective line as said B3791 or a functional equivalent or a homologue thereof as depicted in column 7 of table II, application no. 1, preferably a homologue or functional equivalent as depicted in column 7 of table II B, application no. 1, and being depicted in the same respective line as said B3791, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "hydro-lyase", preferably it is the molecule of section (a) or (b) of this paragraph.

In one embodiment, said molecule, which activity is to be increased in the process of the invention and which is the gene product with an activity as described as a "hydro-lyase", is increased cytoplasmic.

The sequence of B3825 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as lysophospholipase.

Accordingly, in one embodiment, the process of the present invention comprises increasing or generating the activity of a gene product with the activity of a "lysophospholipase" from *Escherichia coli* or its functional equivalent or its homolog, e.g. the increase of (a) a gene product of a gene comprising the nucleic acid molecule as shown in column 5 of table I, application no. 1, and being depicted in the same respective line as said B3825 or a functional equivalent or a homologue thereof as shown in column 7 of table I, application no. 1, preferably a homologue or functional equivalent as shown in column 7 of table I B, application no. 1, and being depicted in the same respective line as said B3825; or (b) a polypeptide comprising a polypeptide, a consensus sequence or a polypeptide motif as shown in column 5 of table II or in column 7 of table IV, application no. 1, respectively, and being depicted in the same respective line as said B3825 or a functional equivalent or a homologue thereof as depicted in column 7 of table II, application no. 1, preferably a homologue or functional equivalent as depicted in column 7 of table II B, application no. 1, and being depicted in the same respective line as said B3825, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "lysophospholipase", preferably it is the molecule of section (a) or (b) of this paragraph.

In one embodiment, said molecule, which activity is to be increased in the process of the invention and which is the gene product with an activity as described as a "lysophospholipase", is increased plastidic.

The sequence of Yal019w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yal019w-protein.

Accordingly, in one embodiment, the process of the present invention comprises increasing or generating the activity of a gene product with the activity of a "yal019w-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yal019w or a functional equivalent or a homologue thereof as shown in column 7 of table I, application no. 1, preferably a homologue or functional equivalent as shown in column 7 of table I B, application no. 1, and being depicted in the same respective line as said Yal019w; or (b) a polypeptide comprising a polypeptide, a consensus sequence or a polypeptide motif as shown in column 5 of table II or in column 7 of table IV, application no. 1, respectively, and being depicted in the same respective line as said Yal019w or a functional equivalent or a homologue thereof as depicted in column 7 of table II, application no. 1, preferably a homologue or functional equivalent as depicted in column 7 of table II B, application no. 1, and being depicted in the same respective line as said Yal019w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yal019w-protein", preferably it is the molecule of section (a) or (b) of this paragraph.

In one embodiment, said molecule, which activity is to be increased in the process of the invention and which is the gene product with an activity as described as a "yal019w-protein", is increased cytoplasmic.

The sequence of Yar035w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as carnitine acetyltransferase.

Accordingly, in one embodiment, the process of the present invention comprises increasing or generating the activity of a gene product with the activity of a "carnitine acetyltransferase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yar035w or a functional equivalent or a homologue thereof as shown in column 7 of table I, application no. 1, preferably a homologue or functional equivalent as shown in column 7 of table I B, application no. 1, and being depicted in the same respective line as said Yar035w; or
(b) a polypeptide comprising a polypeptide, a consensus sequence or a polypeptide motif as shown in column 5 of table II or in column 7 of table IV, application no. 1, respectively, and being depicted in the same respective line as said Yar035w or a functional equivalent or a homologue thereof as depicted in column 7 of table II, application no. 1, preferably a homologue or functional equivalent as depicted in column 7 of table II B, application no. 1, and being depicted in the same respective line as said Yar035w,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "carnitine acetyltransferase", preferably it is the molecule of section (a) or (b) of this paragraph.

In one embodiment, said molecule, which activity is to be increased in the process of the invention and which is the gene product with an activity as described as a "carnitine acetyltransferase", is increased cytoplasmic.

The sequence of Ybl021c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Transcriptional activator.

Accordingly, in one embodiment, the process of the present invention comprises increasing or generating the activity of a gene product with the activity of a "Transcriptional activator" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ybl021c or a functional equivalent or a homologue thereof as shown in column 7 of table I, application no. 1, preferably a homologue or functional equivalent as shown in column 7 of table I B, application no. 1, and being depicted in the same respective line as said Ybl021c; or
(b) a polypeptide comprising a polypeptide, a consensus sequence or a polypeptide motif as shown in column 5 of table I or in column 7 of table IV, application no. 1, respectively, and being depicted in the same respective line as said Ybl021c or a functional equivalent or a homologue thereof as depicted in column 7 of table II, application no. 1, preferably a homologue or functional equivalent as depicted in column 7 of table II B, application no. 1, and being depicted in the same respective line as said Ybl021c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Transcriptional activator", preferably it is the molecule of section (a) or (b) of this paragraph.

In one embodiment, said molecule, which activity is to be increased in the process of the invention and which is the gene product with an activity as described as a "Transcriptional activator", is increased cytoplasmic.

The sequence of Ybr055c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as splicing factor.

Accordingly, in one embodiment, the process of the present invention comprises increasing or generating the activity of a gene product with the activity of a "splicing factor" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ybr055c or a functional equivalent or a homologue thereof as shown in column 7 of table I, application no. 1, preferably a homologue or functional equivalent as shown in column 7 of table I B, application no. 1, and being depicted in the same respective line as said Ybr055c; or
(b) a polypeptide comprising a polypeptide, a consensus sequence or a polypeptide motif as shown in column 5 of table II or in column 7 of table IV, application no. 1, respectively, and being depicted in the same respective line as said Ybr055c or a functional equivalent or a homologue thereof as depicted in column 7 of table II, application no. 1, preferably a homologue or functional equivalent as depicted in column 7 of table II B, application no. 1, and being depicted in the same respective line as said Ybr055c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "splicing factor", preferably it is the molecule of section (a) or (b) of this paragraph.

In one embodiment, said molecule, which activity is to be increased in the process of the invention and which is the gene product with an activity as described as a "splicing factor", is increased cytoplasmic.

The sequence of YBR128c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as autophagy-specific phosphatidylinositol 3-kinase complex protein subunit.

Accordingly, in one embodiment, the process of the present invention comprises increasing or generating the activity of a gene product with the activity of a "autophagy-specific phosphatidylinositol 3-kinase complex protein subunit" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said YBR128c or a functional equivalent or a homologue thereof as shown in column 7 of table I, application no. 1, preferably a homologue or functional equivalent as shown in column 7 of table I B, application no. 1, and being depicted in the same respective line as said YBR128c; or (b) a polypeptide comprising a polypeptide, a consensus sequence or a polypeptide motif as shown in column 5 of table II or in column 7 of table IV, application no. 1, respectively, and being depicted in the same respective line as said YBR128c or a functional equivalent or a homologue thereof as depicted in column 7 of table II, application no. 1, preferably a homologue or functional equivalent as depicted in column 7 of table II B, application no. 1, and being depicted in the same respective line as said YBR128c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "autophagy-specific phosphatidylinositol 3-kinase complex protein subunit", preferably it is the molecule of section (a) or (b) of this paragraph.

In one embodiment, said molecule, which activity is to be increased in the process of the invention and which is the gene product with an activity as described as a "autophagy-specific phosphatidylinositol 3-kinase complex protein subunit", is increased cytoplasmic.

The sequence of Ybr159w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as microsomal beta-ketoreductase.

Accordingly, in one embodiment, the process of the present invention comprises increasing or generating the activity of a gene product with the activity of a "microsomal beta-keto-reductase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ybr159w or a functional equivalent or a homologue thereof as shown in column 7 of table I, application no. 1, preferably a homologue or functional equivalent as shown in column 7 of table I B, application no. 1, and being depicted in the same respective line as said Ybr159w; or (b) a polypeptide comprising a polypeptide, a consensus sequence or a polypeptide motif as shown in column 5 of table II or in column 7 of table IV, application no. 1, respectively, and being depicted in the same respective line as said Ybr159w or a functional equivalent or a homologue thereof as depicted in column 7 of table II, application no. 1, preferably a homologue or functional equivalent as depicted in column 7 of table II B, application no. 1, and being depicted in the same respective line as said Ybr159w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "microsomal beta-keto-reductase", preferably it is the molecule of section (a) or (b) of this paragraph.

In one embodiment, said molecule, which activity is to be increased in the process of the invention and which is the gene product with an activity as described as a "microsomal beta-keto-reductase", is increased cytoplasmic.

The sequence of Ybr243c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as UDP-N-acetyl-glucosamine-1-P transferase.

Accordingly, in one embodiment, the process of the present invention comprises increasing or generating the activity of a gene product with the activity of a "UDP-Nacetyl-glucosamine-1-P transferase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ybr243c or a functional equivalent or a homologue thereof as shown in column 7 of table I, application no. 1, preferably a homologue or functional equivalent as shown in column 7 of table I B, application no. 1, and being depicted in the same respective line as said Ybr243c; or (b) a polypeptide comprising a polypeptide, a consensus sequence or a polypeptide motif as shown in column 5 of table II or in column 7 of table IV, application no. 1, respectively, and being depicted in the same respective line as said Ybr243c or a functional equivalent or a homologue thereof as depicted in column 7 of table II, application no. 1, preferably a homologue or functional equivalent as depicted in column 7 of table II B, application no. 1, and being depicted in the same respective line as said Ybr243c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "UDP-Nacetyl-glucosamine-1-P transferase", preferably it is the molecule of section (a) or (b) of this paragraph.

In one embodiment, said molecule, which activity is to be increased in the process of the invention and which is the gene product with an activity as described as a "UDP-Nacetyl-glucosamine-1-P transferase", is increased cytoplasmic.

In one embodiment, said molecule, which activity is to be increased in the process of the invention and which is the gene product with an activity as described as a "UDP-Nacetyl-glucosamine-1-P transferase", is increased plastidic.

The sequence of Ybr262c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ybr262c-protein.

Accordingly, in one embodiment, the process of the present invention comprises increasing or generating the activity of a gene product with the activity of a "ybr262c-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ybr262c or a functional equivalent or a homologue thereof as shown in column 7 of table I, application no. 1, preferably a homologue or functional equivalent as shown in column 7 of table I B, application no. 1, and being depicted in the same respective line as said Ybr262c; or (b) a polypeptide comprising a polypeptide, a consensus sequence or a polypeptide motif as shown in column 5 of table II or in column 7 of table IV, application no. 1, respectively, and being depicted in the same respective line as said Ybr262c or a functional equivalent or a homologue thereof as depicted in column 7 of table II, application no. 1, preferably a homologue or functional equivalent as depicted in column 7 of table II B, application no. 1, and being depicted in the same respective line as said Ybr262c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ybr262c-protein", preferably it is the molecule of section (a) or (b) of this paragraph.

In one embodiment, said molecule, which activity is to be increased in the process of the invention and which is the gene product with an activity as described as a "ybr262c-protein", is increased cytoplasmic.

The sequence of Ycr019w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as protein necessary for structural stability of L-A double-stranded RNA-containing particles.

Accordingly, in one embodiment, the process of the present invention comprises increasing or generating the activity of a gene product with the activity of a "protein necessary for structural stability of L-A double-stranded RNA-containing particles" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ycr019w or a functional equivalent or a homologue thereof as shown in column 7 of table I, application no. 1, preferably a homologue or functional equivalent as shown in column 7 of table I B, application no. 1, and being depicted in the same respective line as said Ycr019w; or (b) a polypeptide comprising a polypeptide, a consensus sequence or a polypeptide motif as shown in column 5 of table II or in column 7 of table IV, application no. 1, respectively, and being depicted in the same respective line as said Ycr019w or a functional equivalent or a homologue thereof as depicted in column 7 of table II, application no. 1, preferably a homologue or functional equivalent as depicted in column 7 of table II B, application no. 1, and being depicted in the same respective line as said Ycr019w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "protein necessary for structural stability of L-A double-stranded RNA-containing particles", preferably it is the molecule of section (a) or (b) of this paragraph.

In one embodiment, said molecule, which activity is to be increased in the process of the invention and which is the gene product with an activity as described as a "protein necessary for structural stability of L-A double-stranded RNA-containing particles", is increased cytoplasmic.

The sequence of Ydr070c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YDR070C-protein.

Accordingly, in one embodiment, the process of the present invention comprises increasing or generating the activity of a gene product with the activity of a "YDR070C-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ydr070c or a functional equivalent or a homologue thereof as shown in column 7 of table I, application no. 1, preferably a homologue or functional equivalent as shown in column 7 of table I B, application no. 1, and being depicted in the same respective line as said Ydr070c; or (b) a polypeptide comprising a polypeptide, a consensus sequence or a polypeptide motif as shown in column 5 of table II or in column 7 of table IV, application no. 1, respectively, and being depicted in the same respective line as said Ydr070c or a functional equivalent or a homologue thereof as depicted in column 7 of table II, application no. 1, preferably a homologue or functional equivalent as depicted in column 7 of table II B, application no. 1, and being depicted in the same respective line as said Ydr070c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YDR070C-protein", preferably it is the molecule of section (a) or (b) of this paragraph.

In one embodiment, said molecule, which activity is to be increased in the process of the invention and which is the gene product with an activity as described as a "YDR070C-protein", is increased cytoplasmic.

The sequence of Ydr079w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as chaperone.

Accordingly, in one embodiment, the process of the present invention comprises increasing or generating the activity of a gene product with the activity of a "chaperone" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ydr079w or a functional equivalent or a homologue thereof as shown in column 7 of table I, application no. 1, preferably a homologue or functional equivalent as shown in column 7 of table I B, application no. 1, and being depicted in the same respective line as said Ydr079w; or (b) a polypeptide comprising a polypeptide, a consensus sequence or a polypeptide motif as shown in column 5 of table II or in column 7 of table IV, application no. 1, respectively, and being depicted in the same respective line as said Ydr079w or a functional equivalent or a homologue thereof as depicted in column 7 of table II, application no. 1, preferably a homologue or functional equivalent as depicted in column 7 of table II B, application no. 1, and being depicted in the same respective line as said Ydr079w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "chaperone", preferably it is the molecule of section (a) or (b) of this paragraph.

In one embodiment, said molecule, which activity is to be increased in the process of the invention and which is the gene product with an activity as described as a "chaperone", is increased cytoplasmic.

The sequence of Ydr123c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as helix-loop-helix transcription activator that binds inositol/choline-responsive elements.

Accordingly, in one embodiment, the process of the present invention comprises increasing or generating the activity of a gene product with the activity of a "helix-loop-helix transcription activator that binds inositol/choline-responsive elements" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ydr123c or a functional equivalent or a homologue thereof as shown in column 7 of table I, application no. 1, preferably a homologue or functional equivalent as shown in column 7 of table I B, application no. 1, and being depicted in the same respective line as said Ydr123c; or (b) a polypeptide comprising a polypeptide, a consensus sequence or a polypeptide motif as shown in column 5 of table II or in column 7 of table IV, application no. 1, respectively, and being depicted in the same respective line as said Ydr123c or a functional equivalent or a homologue thereof as depicted in column 7 of table II, application no. 1, preferably a homologue or functional equivalent as depicted in column 7 of table II B, application no. 1, and being depicted in the same respective line as said Ydr123c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "helix-loop-helix transcription activator that binds inositol/choline-responsive elements", preferably it is the molecule of section (a) or (b) of this paragraph.

In one embodiment, said molecule, which activity is to be increased in the process of the invention and which is the gene product with an activity as described as a "helix-loop-helix transcription activator that binds inositol/choline-responsive elements", is increased cytoplasmic.

The sequence of Ydr137w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as golgi membrane exchange factor subunit.

Accordingly, in one embodiment, the process of the present invention comprises increasing or generating the activity of a gene product with the activity of a "golgi membrane exchange factor subunit" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ydr137w or a functional equivalent or a homologue thereof as shown in column 7 of table I, application no. 1, preferably a homologue or functional equivalent as shown in column 7 of table I B, application no. 1, and being depicted in the same respective line as said Ydr137w; or (b) a polypeptide comprising a polypeptide, a consensus sequence or a polypeptide motif as shown in column 5 of table II or in column 7 of table IV, application no. 1, respectively, and being depicted in the same respective line as said Ydr137w or a functional equivalent or a homologue thereof as depicted in column 7 of table II, application no. 1, preferably a homologue or functional equivalent as depicted in column 7 of table II B, application no. 1, and being depicted in the same respective line as said Ydr137w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "golgi membrane exchange factor subunit", preferably it is the molecule of section (a) or (b) of this paragraph.

In one embodiment, said molecule, which activity is to be increased in the process of the invention and which is the gene product with an activity as described as a "golgi membrane exchange factor subunit", is increased cytoplasmic.

The sequence of Ydr294c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as dihydrosphingosine phosphate lyase.

Accordingly, in one embodiment, the process of the present invention comprises increasing or generating the activity of a gene product with the activity of a "dihydrosphingosine phosphate lyase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ydr294c or a functional equivalent or a homologue thereof as shown in column 7 of table I, application no. 1, preferably a homologue or functional equivalent as shown in column 7 of table I B, application no. 1, and being depicted in the same respective line as said Ydr294c; or
(b) a polypeptide comprising a polypeptide, a consensus sequence or a polypeptide motif as shown in column 5 of table II or in column 7 of table IV, application no. 1, respectively, and being depicted in the same respective line as said Ydr294c or a functional equivalent or a homologue thereof as depicted in column 7 of table II, application no. 1, preferably a homologue or functional equivalent as depicted in column 7 of table II B, application no. 1, and being depicted in the same respective line as said Ydr294c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "dihydrosphingosine phosphate lyase", preferably it is the molecule of section (a) or (b) of this paragraph.

In one embodiment, said molecule, which activity is to be increased in the process of the invention and which is the gene product with an activity as described as a "dihydrosphingosine phosphate lyase", is increased cytoplasmic.

In one embodiment, said molecule, which activity is to be increased in the process of the invention and which is the gene product with an activity as described as a "dihydrosphingosine phosphate lyase", is increased plastidic.

The sequence of Ydr330w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ubiquitin regulatory protein.

Accordingly, in one embodiment, the process of the present invention comprises increasing or generating the activity of a gene product with the activity of a "ubiquitin regulatory protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ydr330w or a functional equivalent or a homologue thereof as shown in column 7 of table I, application no. 1, preferably a homologue or functional equivalent as shown in column 7 of table I B, application no. 1, and being depicted in the same respective line as said Ydr330w; or
(b) a polypeptide comprising a polypeptide, a consensus sequence or a polypeptide motif as shown in column 5 of table II or in column 7 of table IV, application no. 1, respectively, and being depicted in the same respective line as said Ydr330w or a functional equivalent or a homologue thereof as depicted in column 7 of table II, application no. 1, preferably a homologue or functional equivalent as depicted in column 7 of table II B, application no. 1, and being depicted in the same respective line as said Ydr330w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ubiquitin regulatory protein", preferably it is the molecule of section (a) or (b) of this paragraph.

In one embodiment, said molecule, which activity is to be increased in the process of the invention and which is the gene product with an activity as described as a "ubiquitin regulatory protein", is increased cytoplasmic.

The sequence of Ydr355c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ydr355c-protein.

Accordingly, in one embodiment, the process of the present invention comprises increasing or generating the activity of a gene product with the activity of a "ydr355c-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ydr355c or a functional equivalent or a homologue thereof as shown in column 7 of table I, application no. 1, preferably a homologue or functional equivalent as shown in column 7 of table I B, application no. 1, and being depicted in the same respective line as said Ydr355c; or
(b) a polypeptide comprising a polypeptide, a consensus sequence or a polypeptide motif as shown in column 5 of table II or in column 7 of table IV, application no. 1, respectively, and being depicted in the same respective line as said Ydr355c or a functional equivalent or a homologue thereof as depicted in column 7 of table II, application no. 1, preferably a homologue or functional equivalent as depicted in column 7 of table II B, application no. 1, and being depicted in the same respective line as said Ydr355c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ydr355c-protein", preferably it is the molecule of section (a) or (b) of this paragraph.

In one embodiment, said molecule, which activity is to be increased in the process of the invention and which is the gene product with an activity as described as a "ydr355c-protein", is increased cytoplasmic.

The sequence of YDR430C from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as lysine-specific metalloprotease.

Accordingly, in one embodiment, the process of the present invention comprises increasing or generating the activity of a gene product with the activity of a "lysinespecific metalloprotease" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YDR430C or a functional equivalent or a homologue thereof as shown in column 7 of table I, application no. 1, preferably a homologue or functional equivalent as shown in column 7 of table I B, application no. 1, and being depicted in the same respective line as said YDR430C; or
(b) a polypeptide comprising a polypeptide, a consensus sequence or a polypeptide motif as shown in column 5 of table II or in column 7 of table IV, application no. 1, respectively, and being depicted in the same respective line as said YDR430C or a functional equivalent or a homologue thereof as depicted in column 7 of table II, application no. 1, preferably a homologue or functional equivalent as depicted in column 7 of table II B, application no. 1, and being depicted in the same respective line as said YDR430C,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "lysine-specific metalloprotease", preferably it is the molecule of section (a) or (b) of this paragraph.

In one embodiment, said molecule, which activity is to be increased in the process of the invention and which is the gene product with an activity as described as a "lysine-specific metalloprotease", is increased plastidic.

The sequence of Ydr472w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as subunit of the transport protein particle (TRAPP) complex of the cis-Golgi.

Accordingly, in one embodiment, the process of the present invention comprises increasing or generating the activity of a gene product with the activity of a "subunit of the transport protein particle (TRAPP) complex of the cis-Golgi" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ydr472w or a functional equivalent or a homologue thereof as shown in column 7 of table I, application no. 1, preferably a homologue or functional equivalent as shown in column 7 of table I B, application no. 1, and being depicted in the same respective line as said Ydr472w; or
(b) a polypeptide comprising a polypeptide, a consensus sequence or a polypeptide motif as shown in column 5 of table II or in column 7 of table IV, application no. 1, respectively, and being depicted in the same respective line as said Ydr472w or a functional equivalent or a homologue thereof as depicted in column 7 of table II, application no. 1, preferably a homologue or functional equivalent as depicted in column 7 of table II B, application no. 1, and being depicted in the same respective line as said Ydr472w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "subunit of the transport protein particle (TRAPP) complex of the cis-Golgi", preferably it is the molecule of section (a) or (b) of this paragraph.

In one embodiment, said molecule, which activity is to be increased in the process of the invention and which is the gene product with an activity as described as a "subunit of the transport protein particle (TRAPP) complex of the cis-Golgi", is increased cytoplasmic.

The sequence of YDR497c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as myo-inositol transporter.

Accordingly, in one embodiment, the process of the present invention comprises increasing or generating the activity of a gene product with the activity of a "myo-inositol transporter" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YDR497c or a functional equivalent or a homologue thereof as shown in column 7 of table I, application no. 1, preferably a homologue or functional equivalent as shown in column 7 of table I B, application no. 1, and being depicted in the same respective line as said YDR497c; or
(b) a polypeptide comprising a polypeptide, a consensus sequence or a polypeptide motif as shown in column 5 of table II or in column 7 of table IV, application no. 1, respectively, and being depicted in the same respective line as said YDR497c or a functional equivalent or a homologue thereof as depicted in column 7 of table II, application no. 1, preferably a homologue or functional equivalent as depicted in column 7 of table II B, application no. 1, and being depicted in the same respective line as said YDR497c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "myoinositol transporter", preferably it is the molecule of section (a) or (b) of this paragraph.

In one embodiment, said molecule, which activity is to be increased in the process of the invention and which is the gene product with an activity as described as a "myoinositol transporter", is increased plastidic.

The sequence of Yer029c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as SM complex B protein for mRNA splicing.

Accordingly, in one embodiment, the process of the present invention comprises increasing or generating the activity of a gene product with the activity of a "SM complex B protein for mRNA splicing" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yer029c or a functional equivalent or a homologue thereof as shown in column 7 of table I, application no. 1, preferably a homologue or functional equivalent as shown in column 7 of table I B, application no. 1, and being depicted in the same respective line as said Yer029c; or
(b) a polypeptide comprising a polypeptide, a consensus sequence or a polypeptide motif as shown in column 5 of table II or in column 7 of table IV, application no. 1, respectively, and being depicted in the same respective line as said Yer029c or a functional equivalent or a homologue thereof as depicted in column 7 of table II, application no. 1, preferably a homologue or functional equivalent as depicted in column 7 of table II B, application no. 1, and being depicted in the same respective line as said Yer029c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "SM complex B protein for mRNA splicing", preferably it is the molecule of section (a) or (b) of this paragraph.

In one embodiment, said molecule, which activity is to be increased in the process of the invention and which is the gene product with an activity as described as a "SM complex B protein for mRNA splicing", is increased cytoplasmic.

The sequence of YFR007W from *Saccharomyces cerevisiae*, e.g. as shown in column of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YFR007W-protein.

Accordingly, in one embodiment, the process of the present invention comprises increasing or generating the activity of a gene product with the activity of a "YFR007W-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YFR007W or a functional equivalent or a homologue thereof as shown in column 7 of table I, application no. 1, preferably a homologue or functional equivalent as shown in column 7 of table I B, application no. 1, and being depicted in the same respective line as said YFR007W; or
(b) a polypeptide comprising a polypeptide, a consensus sequence or a polypeptide motif as shown in column 5 of table II or in column 7 of table IV, application no. 1, respectively, and being depicted in the same respective line as said YFR007W or a functional equivalent or a homologue thereof as depicted in column 7 of table II, application no. 1, preferably a homologue or functional equivalent as depicted in column 7 of table II B, application no. 1, and being depicted in the same respective line as said YFR007W,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YFR007W-protein", preferably it is the molecule of section (a) or (b) of this paragraph.

In one embodiment, said molecule, which activity is to be increased in the process of the invention and which is the gene product with an activity as described as a "YFR007W-protein", is increased cytoplasmic.

The sequence of YGL039W from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as oxidoreductase.

Accordingly, in one embodiment, the process of the present invention comprises increasing or generating the activity of a gene product with the activity of a "oxidoreductase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YGL039W or a functional equivalent or a homologue thereof as shown in column 7 of table I, application no. 1, preferably a homologue or functional equivalent as shown in column 7 of table I B, application no. 1, and being depicted in the same respective line as said YGL039W; or
(b) a polypeptide comprising a polypeptide, a consensus sequence or a polypeptide motif as shown in column 5 of table II or in column 7 of table IV, application no. 1, respectively, and being depicted in the same respective line as said YGL039W or a functional equivalent or a homologue thereof as depicted in column 7 of table II, application no. 1, preferably a homologue or functional equivalent as depicted in column 7 of table II B, application no. 1, and being depicted in the same respective line as said YGL039W,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "oxidoreductase", preferably it is the molecule of section (a) or (b) of this paragraph.

In one embodiment, said molecule, which activity is to be increased in the process of the invention and which is the gene product with an activity as described as a "oxidoreductase", is increased cytoplasmic.

The sequence of Ygl043w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as transcription elongation factor.

Accordingly, in one embodiment, the process of the present invention comprises increasing or generating the activity of a gene product with the activity of a "transcription elongation factor" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygl043w or a functional equivalent or a homologue thereof as shown in column 7 of table I, application no. 1, preferably a homologue or functional equivalent as shown in column 7 of table I B, application no. 1, and being depicted in the same respective line as said Ygl043w; or
(b) a polypeptide comprising a polypeptide, a consensus sequence or a polypeptide motif as shown in column 5 of table II or in column 7 of table IV, application no. 1, respectively, and being depicted in the same respective line as said Ygl043w or a functional equivalent or a homologue thereof as depicted in column 7 of table II, application no. 1, preferably a homologue or functional equivalent as depicted in column 7 of table II B, application no. 1, and being depicted in the same respective line as said Ygl043w,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "transcription elongation factor", preferably it is the molecule of section (a) or (b) of this paragraph.

In one embodiment, said molecule, which activity is to be increased in the process of the invention and which is the gene product with an activity as described as a "transcription elongation factor", is increased cytoplasmic.

The sequence of Ygr088w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as cytosolic catalase.

Accordingly, in one embodiment, the process of the present invention comprises increasing or generating the activity of a gene product with the activity of a "cytosolic catalase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr088w or a functional equivalent or a homologue thereof as shown in column 7 of table I, application no. 1, preferably a homologue or functional equivalent as shown in column 7 of table I B, application no. 1, and being depicted in the same respective line as said Ygr088w; or
(b) a polypeptide comprising a polypeptide, a consensus sequence or a polypeptide motif as shown in column 5 of table II or in column 7 of table IV, application no. 1, respectively, and being depicted in the same respective line as said Ygr088w or a functional equivalent or a homologue thereof as depicted in column 7 of table II, application no. 1, preferably a homologue or functional equivalent as depicted in column 7 of table II B, application no. 1, and being depicted in the same respective line as said Ygr088w,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "cytosolic catalase", preferably it is the molecule of section (a) or (b) of this paragraph.

In one embodiment, said molecule, which activity is to be increased in the process of the invention and which is the gene product with an activity as described as a "cytosolic catalase", is increased cytoplasmic.

The sequence of Ygr122c-a from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ygr122c-a-protein.

Accordingly, in one embodiment, the process of the present invention comprises increasing or generating the activity of a gene product with the activity of a "ygr122c-a-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr122c-a or a functional equivalent or a homologue thereof as shown in column 7 of table I, application no. 1, preferably a homologue or functional equivalent as shown in column 7 of table I B, application no. 1, and being depicted in the same respective line as said Ygr122c-a; or
(b) a polypeptide comprising a polypeptide, a consensus sequence or a polypeptide motif as shown in column 5 of table II or in column 7 of table IV, application no. 1, respectively, and being depicted in the same respective line as said Ygr122c-a or a functional equivalent or a homologue thereof as depicted in column 7 of table II, application no. 1, preferably a homologue or functional equivalent as depicted in column 7 of table II B, application no. 1, and being depicted in the same respective line as said Ygr122c-a, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ygr122ca-protein", preferably it is the molecule of section (a) or (b) of this paragraph.

In one embodiment, said molecule, which activity is to be increased in the process of the invention and which is the gene product with an activity as described as a "ygr122ca-protein", is increased cytoplasmic.

The sequence of Ygr142w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as v-SNARE binding protein.

Accordingly, in one embodiment, the process of the present invention comprises increasing or generating the activity of a gene product with the activity of a "v-SNARE binding protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr142w or a functional equivalent or a homologue thereof as shown in column 7 of table I, application no. 1, preferably a homologue or functional equivalent as shown in column 7 of table I B, application no. 1, and being depicted in the same respective line as said Ygr142w; or
(b) a polypeptide comprising a polypeptide, a consensus sequence or a polypeptide motif as shown in column 5 of table II or in column 7 of table IV, application no. 1, respectively, and being depicted in the same respective line as said Ygr142w or a functional equivalent or a homologue thereof as depicted in column 7 of table II, application no. 1, preferably a homologue or functional equivalent as depicted in column 7 of table II B, application no. 1, and being depicted in the same respective line as said Ygr142w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "v-SNARE binding protein", preferably it is the molecule of section (a) or (b) of this paragraph.

In one embodiment, said molecule, which activity is to be increased in the process of the invention and which is the gene product with an activity as described as a "v-SNARE binding protein", is increased cytoplasmic.

The sequence of Ygr143w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as protein involved in sphingolipid biosynthesis.

Accordingly, in one embodiment, the process of the present invention comprises increasing or generating the activity of a gene product with the activity of a "protein involved in sphingolipid biosynthesis" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr143w or a functional equivalent or a homologue thereof as shown in column 7 of table I, application no. 1, preferably a homologue or functional equivalent as shown in column 7 of table I B, application no. 1, and being depicted in the same respective line as said Ygr143w; or
(b) a polypeptide comprising a polypeptide, a consensus sequence or a polypeptide motif as shown in column 5 of table II or in column 7 of table IV, application no. 1, respectively, and being depicted in the same respective line as said Ygr143w or a functional equivalent or a homologue thereof as depicted in column 7 of table II, application no. 1, preferably a homologue or functional equivalent as depicted in column 7 of table II B, application no. 1, and being depicted in the same respective line as said Ygr143w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "protein involved in sphingolipid biosynthesis", preferably it is the molecule of section (a) or (b) of this paragraph.

In one embodiment, said molecule, which activity is to be increased in the process of the invention and which is the gene product with an activity as described as a "protein involved in sphingolipid biosynthesis", is increased cytoplasmic.

The sequence of Ygr165w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as mitochondrial ribosomal protein of the small subunit.

Accordingly, in one embodiment, the process of the present invention comprises increasing or generating the activity of a gene product with the activity of a "mitochondrial ribosomal protein of the small subunit" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr165w or a functional equivalent or a homologue thereof as shown in column 7 of table I, application no. 1, preferably a homologue or functional equivalent as shown in column 7 of table I B, application no. 1, and being depicted in the same respective line as said Ygr165w; or
(b) a polypeptide comprising a polypeptide, a consensus sequence or a polypeptide motif as shown in column 5 of table II or in column 7 of table IV, application no. 1, respectively, and being depicted in the same respective line as said Ygr165w or a functional equivalent or a homologue thereof as depicted in column 7 of table II, application no. 1, preferably a homologue or functional equivalent as depicted in column 7 of table II B, application no. 1, and being depicted in the same respective line as said Ygr165w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "mitochondrial ribosomal protein of the small subunit", preferably it is the molecule of section (a) or (b) of this paragraph.

In one embodiment, said molecule, which activity is to be increased in the process of the invention and which is the gene product with an activity as described as a "mitochondrial ribosomal protein of the small subunit", is increased cytoplasmic.

The sequence of Ygr170w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as phosphatidylserine decarboxylase.

Accordingly, in one embodiment, the process of the present invention comprises increasing or generating the activity of a gene product with the activity of a "phosphatidylserine decarboxylase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr170w or a functional equivalent or a homologue thereof as shown in column 7 of table I, application no. 1, preferably a homologue or functional equivalent as shown in column 7 of table I B, application no. 1, and being depicted in the same respective line as said Ygr170w; or
(b) a polypeptide comprising a polypeptide, a consensus sequence or a polypeptide motif as shown in column 5 of table II or in column 7 of table IV, application no. 1, respectively, and being depicted in the same respective line as said Ygr170w or a functional equivalent or a homologue thereof as depicted in column 7 of table II, application no. 1, preferably a homologue or functional equivalent as depicted in column 7 of table II B, application no. 1, and being depicted in the same respective line as said Ygr170w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "phosphatidylserine decarboxylase", preferably it is the molecule of section (a) or (b) of this paragraph.

In one embodiment, said molecule, which activity is to be increased in the process of the invention and which is the gene product with an activity as described as a "phosphatidylserine decarboxylase", is increased cytoplasmic.

The sequence of Ygr202c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as cholinephosphate cytidylyltransferase.

Accordingly, in one embodiment, the process of the present invention comprises increasing or generating the activity of a gene product with the activity of a "cholinephosphate cytidylyltransferase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr202c or a functional equivalent or a homologue thereof as shown in column 7 of table I, application no. 1, preferably a homologue or functional equivalent as shown in column 7 of table I B, application no. 1, and being depicted in the same respective line as said Ygr202c; or
(b) a polypeptide comprising a polypeptide, a consensus sequence or a polypeptide motif as shown in column 5 of table II or in column 7 of table IV, application no. 1, respectively, and being depicted in the same respective line as said Ygr202c or a functional equivalent or a homologue thereof as depicted in column 7 of table II, application no. 1, preferably a homologue or functional equivalent as depicted in column 7 of table II B, application no. 1, and being depicted in the same respective line as said Ygr202c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "cholinephosphate cytidylyltransferase", preferably it is the molecule of section (a) or (b) of this paragraph.

In one embodiment, said molecule, which activity is to be increased in the process of the invention and which is the gene product with an activity as described as a "cholinephosphate cytidylyltransferase", is increased cytoplasmic.

The sequence of Ygr266w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ygr266w-protein.

Accordingly, in one embodiment, the process of the present invention comprises increasing or generating the activity of a gene product with the activity of a "ygr266w-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr266w or a functional equivalent or a homologue thereof as shown in column 7 of table I, application no. 1, preferably a homologue or functional equivalent as shown in column 7 of table I B, application no. 1, and being depicted in the same respective line as said Ygr266w; or
(b) a polypeptide comprising a polypeptide, a consensus sequence or a polypeptide motif as shown in column 5 of table II or in column 7 of table IV, application no. 1, respectively, and being depicted in the same respective line as said Ygr266w or a functional equivalent or a homologue thereof as depicted in column 7 of table II, application no. 1, preferably a homologue or functional equivalent as depicted in column 7 of table II B, application no. 1, and being depicted in the same respective line as said Ygr266w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ygr266w-protein", preferably it is the molecule of section (a) or (b) of this paragraph.

In one embodiment, said molecule, which activity is to be increased in the process of the invention and which is the gene product with an activity as described as a "ygr266w-protein", is increased cytoplasmic.

The sequence of Ygr282c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as cell wall endo-beta-1,3-glucanase.

Accordingly, in one embodiment, the process of the present invention comprises increasing or generating the activity of a gene product with the activity of a "cell wall endo-beta-1,3-glucanase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr282c or a functional equivalent or a homologue thereof as shown in column 7 of table I, application no. 1, preferably a homologue or functional equivalent as shown in column 7 of table I B, application no. 1, and being depicted in the same respective line as said Ygr282c; or
(b) a polypeptide comprising a polypeptide, a consensus sequence or a polypeptide motif as shown in column 5 of table II or in column 7 of table IV, application no. 1, respectively, and being depicted in the same respective line as said Ygr282c or a functional equivalent or a homologue thereof as depicted in column 7 of table II, application no. 1, preferably a homologue or functional equivalent as depicted in column 7 of table II B, application no. 1, and being depicted in the same respective line as said Ygr282c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "cell wall endo-beta-1,3-glucanase", preferably it is the molecule of section (a) or (b) of this paragraph.

In one embodiment, said molecule, which activity is to be increased in the process of the invention and which is the gene product with an activity as described as a "cell wall endo-beta-1,3-glucanase", is increased cytoplasmic.

The sequence of Ygr290w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ygr290w-protein.

Accordingly, in one embodiment, the process of the present invention comprises increasing or generating the activity of a gene product with the activity of a "ygr290w-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ygr290w or a functional equivalent or a homologue thereof as shown in column 7 of table I, application no. 1, preferably a homologue or functional equivalent as shown in column 7 of table I B, application no. 1, and being depicted in the same respective line as said Ygr290w; or
(b) a polypeptide comprising a polypeptide, a consensus sequence or a polypeptide motif as shown in column 5 of table II or in column 7 of table IV, application no. 1, respectively, and being depicted in the same respective line as said Ygr290w or a functional equivalent or a homologue thereof as depicted in column 7 of table II, application no.

1, preferably a homologue or functional equivalent as depicted in column 7 of table II B, application no. 1, and being depicted in the same respective line as said Ygr290w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ygr290w-protein", preferably it is the molecule of section (a) or (b) of this paragraph.

In one embodiment, said molecule, which activity is to be increased in the process of the invention and which is the gene product with an activity as described as a "ygr290w-protein", is increased cytoplasmic.

The sequence of Yhl021c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yhl021c-protein.

Accordingly, in one embodiment, the process of the present invention comprises increasing or generating the activity of a gene product with the activity of a "yhl021c-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yhl021c or a functional equivalent or a homologue thereof as shown in column 7 of table I, application no. 1, preferably a homologue or functional equivalent as shown in column 7 of table I B, application no. 1, and being depicted in the same respective line as said Yhl021c; or
(b) a polypeptide comprising a polypeptide, a consensus sequence or a polypeptide motif as shown in column 5 of table II or in column 7 of table IV, application no. 1, respectively, and being depicted in the same respective line as said Yhl021c or a functional equivalent or a homologue thereof as depicted in column 7 of table II, application no. 1, preferably a homologue or functional equivalent as depicted in column 7 of table II B, application no. 1, and being depicted in the same respective line as said Yhl021c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yhl021c-protein", preferably it is the molecule of section (a) or (b) of this paragraph.

In one embodiment, said molecule, which activity is to be increased in the process of the invention and which is the gene product with an activity as described as a "yhl021c-protein", is increased cytoplasmic.

The sequence of Yhl031c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as v-SNARE protein involved in Golgi transport.

Accordingly, in one embodiment, the process of the present invention comprises increasing or generating the activity of a gene product with the activity of a "v-SNARE protein involved in Golgi transport" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yhl031c or a functional equivalent or a homologue thereof as shown in column 7 of table I, application no. 1, preferably a homologue or functional equivalent as shown in column 7 of table I B, application no. 1, and being depicted in the same respective line as said Yhl031c; or
(b) a polypeptide comprising a polypeptide, a consensus sequence or a polypeptide motif as shown in column 5 of table II or in column 7 of table IV, application no. 1, respectively, and being depicted in the same respective line as said Yhl031c or a functional equivalent or a homologue thereof as depicted in column 7 of table II, application no. 1, preferably a homologue or functional equivalent as depicted in column 7 of table II B, application no. 1, and being depicted in the same respective line as said Yhl031c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "v-SNARE protein involved in Golgi transport", preferably it is the molecule of section (a) or (b) of this paragraph.

In one embodiment, said molecule, which activity is to be increased in the process of the invention and which is the gene product with an activity as described as a "v-SNARE protein involved in Golgi transport", is increased cytoplasmic.

The sequence of Yhr011w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as mitochondrial seryl-tRNA synthetase.

Accordingly, in one embodiment, the process of the present invention comprises increasing or generating the activity of a gene product with the activity of a "mitochondrial seryl-tRNA synthetase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yhr011w or a functional equivalent or a homologue thereof as shown in column 7 of table I, application no. 1, preferably a homologue or functional equivalent as shown in column 7 of table I B, application no. 1, and being depicted in the same respective line as said Yhr011w; or
(b) a polypeptide comprising a polypeptide, a consensus sequence or a polypeptide motif as shown in column 5 of table II or in column 7 of table IV, application no. 1, respectively, and being depicted in the same respective line as said Yhr011w or a functional equivalent or a homologue thereof as depicted in column 7 of table II, application no. 1, preferably a homologue or functional equivalent as depicted in column 7 of table II B, application no. 1, and being depicted in the same respective line as said Yhr011w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "mitochondrial seryl-tRNA synthetase", preferably it is the molecule of section (a) or (b) of this paragraph.

In one embodiment, said molecule, which activity is to be increased in the process of the invention and which is the gene product with an activity as described as a "mitochondrial seryl-tRNA synthetase", is increased cytoplasmic.

The sequence of Yhr127w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yhr127w-protein.

Accordingly, in one embodiment, the process of the present invention comprises increasing or generating the activity of a gene product with the activity of a "yhr127w-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yhr127w or a functional equivalent or a homologue thereof as shown in column 7 of table I, application no. 1, preferably a homologue or functional equivalent as shown in column 7 of table I B, application no. 1, and being depicted in the same respective line as said Yhr127w; or (b) a polypeptide comprising a polypeptide, a consensus sequence or a polypeptide motif as shown in column 5 of table II or in column 7 of table IV, application no. 1, respectively, and being depicted in the same respective line as said Yhr127w or a functional equivalent or a homologue thereof as depicted in column 7 of table II, application no. 1, preferably a homologue or functional equivalent as depicted in column 7 of table II B, application no. 1, and being depicted in the same respective line as said Yhr127w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yhr127w-protein", preferably it is the molecule of section (a) or (b) of this paragraph.

In one embodiment, said molecule, which activity is to be increased in the process of the invention and which is the gene product with an activity as described as a "yhr127w-protein", is increased cytoplasmic.

The sequence of Yhr137w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as aromatic amino acid aminotransferase II.

Accordingly, in one embodiment, the process of the present invention comprises increasing or generating the activity of a gene product with the activity of a "aromatic amino acid aminotransferase II" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yhr137w or a functional equivalent or a homologue thereof as shown in column 7 of table I, application no. 1, preferably a homologue or functional equivalent as shown in column 7 of table I B, application no. 1, and being depicted in the same respective line as said Yhr137w; or (b) a polypeptide comprising a polypeptide, a consensus sequence or a polypeptide motif as shown in column 5 of table II or in column 7 of table IV, application no. 1, respectively, and being depicted in the same respective line as said Yhr137w or a functional equivalent or a homologue thereof as depicted in column 7 of table II, application no. 1, preferably a homologue or functional equivalent as depicted in column 7 of table II B, application no. 1, and being depicted in the same respective line as said Yhr137w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "aromatic amino acid aminotransferase II", preferably it is the molecule of section (a) or (b) of this paragraph.

In one embodiment, said molecule, which activity is to be increased in the process of the invention and which is the gene product with an activity as described as a "aromatic amino acid aminotransferase II", is increased cytoplasmic.

In one embodiment, said molecule, which activity is to be increased in the process of the invention and which is the gene product with an activity as described as a "aromatic amino acid aminotransferase II", is increased plastidic.

The sequence of Yil099w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as glucoamylase.

Accordingly, in one embodiment, the process of the present invention comprises increasing or generating the activity of a gene product with the activity of a "glucoamylase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yil099w or a functional equivalent or a homologue thereof as shown in column 7 of table I, application no. 1, preferably a homologue or functional equivalent as shown in column 7 of table I B, application no. 1, and being depicted in the same respective line as said Yil099w; or (b) a polypeptide comprising a polypeptide, a consensus sequence or a polypeptide motif as shown in column 5 of table II or in column 7 of table IV, application no. 1, respectively, and being depicted in the same respective line as said Yil099w or a functional equivalent or a homologue thereof as depicted in column 7 of table II, application no. 1, preferably a homologue or functional equivalent as depicted in column 7 of table II B, application no. 1, and being depicted in the same respective line as said Yil099w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "glucoamylase", preferably it is the molecule of section (a) or (b) of this paragraph.

In one embodiment, said molecule, which activity is to be increased in the process of the invention and which is the gene product with an activity as described as a "glucoamylase", is increased cytoplasmic.

In one embodiment, said molecule, which activity is to be increased in the process of the invention and which is the gene product with an activity as described as a "glucoamylase", is increased plastidic.

The sequence of Yil147c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as histidine kinase osmosensor that regulates an osmosensing MAP kinase cascade.

Accordingly, in one embodiment, the process of the present invention comprises increasing or generating the activity of a gene product with the activity of a "histidine kinase osmosensor that regulates an osmosensing MAP kinase cascade" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yil147c or a functional equivalent or a homologue thereof as shown in column 7 of table I, application no. 1, preferably a homologue or functional equivalent as shown in column 7 of table I B, application no. 1, and being depicted in the same respective line as said Yil147c; or (b) a polypeptide comprising a polypeptide, a consensus sequence or a polypeptide motif as shown in column 5 of table II or in column 7 of table IV, application no. 1, respectively, and being depicted in the same respective line as said Yil147c or a functional equivalent or a homologue thereof as depicted in column 7 of table II, application no. 1, preferably a homologue or functional equivalent as depicted in column 7 of table II B, application no. 1, and being depicted in the same respective line as said Yil147c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "histidine kinase osmosensor that regulates an osmosensing MAP kinase cascade", preferably it is the molecule of section (a) or (b) of this paragraph.

In one embodiment, said molecule, which activity is to be increased in the process of the invention and which is the gene product with an activity as described as a "histidine kinase osmosensor that regulates an osmosensing MAP kinase cascade", is increased cytoplasmic.

The sequence of Yir034c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as saccharopine dehydrogenase.

Accordingly, in one embodiment, the process of the present invention comprises increasing or generating the activity of a gene product with the activity of a "saccharopine dehydrogenase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yir034c or a functional equivalent or a homologue thereof as shown in column 7 of table I, application no. 1, preferably a homologue or functional equivalent as shown in column 7 of table I B, application no. 1, and being depicted in the same respective line as said Yir034c; or (b) a polypeptide comprising a polypeptide, a consensus sequence or a polypeptide motif as shown in column 5 of table II or in column 7 of table IV, application no. 1, respectively, and being depicted in the same respective line as said Yir034c or a functional equivalent or a homologue thereof as depicted in column 7 of table II, application no. 1, preferably a homologue or functional equivalent as depicted in column 7 of table II B, application no. 1, and being depicted in the same respective line as said Yir034c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "saccharopine dehydrogenase", preferably it is the molecule of section (a) or (b) of this paragraph.

In one embodiment, said molecule, which activity is to be increased in the process of the invention and which is the gene product with an activity as described as a "saccharopine dehydrogenase", is increased cytoplasmic.

The sequence of Yjl013c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as spindle checkpoint complex subunit.

Accordingly, in one embodiment, the process of the present invention comprises increasing or generating the activity of a gene product with the activity of a "spindle checkpoint complex subunit" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yjl013c or a functional equivalent or a homologue thereof as shown in column 7 of table I, application no. 1, preferably a homologue or functional equivalent as shown in column 7 of table I B, application no. 1, and being depicted in the same respective line as said Yjl013c; or
(b) a polypeptide comprising a polypeptide, a consensus sequence or a polypeptide motif as shown in column 5 of table II or in column 7 of table IV, application no. 1, respectively, and being depicted in the same respective line as said Yjl013c or a functional equivalent or a homologue thereof as depicted in column 7 of table II, application no. 1, preferably a homologue or functional equivalent as depicted in column 7 of table II B, application no. 1, and being depicted in the same respective line as said Yjl013c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "spindle checkpoint complex subunit", preferably it is the molecule of section (a) or (b) of this paragraph.

In one embodiment, said molecule, which activity is to be increased in the process of the invention and which is the gene product with an activity as described as a "spindle checkpoint complex subunit", is increased cytoplasmic.

The sequence of Yjl041w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as nuclear pore complex subunit.

Accordingly, in one embodiment, the process of the present invention comprises increasing or generating the activity of a gene product with the activity of a "nuclear pore complex subunit" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yjl041w or a functional equivalent or a homologue thereof as shown in column 7 of table I, application no. 1, preferably a homologue or functional equivalent as shown in column 7 of table I B, application no. 1, and being depicted in the same respective line as said Yjl041w; or
(b) a polypeptide comprising a polypeptide, a consensus sequence or a polypeptide motif as shown in column 5 of table II or in column 7 of table IV, application no. 1, respectively, and being depicted in the same respective line as said Yjl041w or a functional equivalent or a homologue thereof as depicted in column 7 of table II, application no. 1, preferably a homologue or functional equivalent as depicted in column 7 of table II B, application no. 1, and being depicted in the same respective line as said Yjl041w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "nuclear pore complex subunit", preferably it is the molecule of section (a) or (b) of this paragraph.

In one embodiment, said molecule, which activity is to be increased in the process of the invention and which is the gene product with an activity as described as a "nuclear pore complex subunit", is increased cytoplasmic.

The sequence of Yjl064w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yjl064w-protein.

Accordingly, in one embodiment, the process of the present invention comprises increasing or generating the activity of a gene product with the activity of a "yjl064w-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yjl064w or a functional equivalent or a homologue thereof as shown in column 7 of table I, application no. 1, preferably a homologue or functional equivalent as shown in column 7 of table I B, application no. 1, and being depicted in the same respective line as said Yjl064w; or
(b) a polypeptide comprising a polypeptide, a consensus sequence or a polypeptide motif as shown in column 5 of table II or in column 7 of table IV, application no. 1, respectively, and being depicted in the same respective line as said Yjl064w or a functional equivalent or a homologue thereof as depicted in column 7 of table II, application no. 1, preferably a homologue or functional equivalent as depicted in column 7 of table II B, application no. 1, and being depicted in the same respective line as said Yjl064w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yjl064w-protein", preferably it is the molecule of section (a) or (b) of this paragraph.

In one embodiment, said molecule, which activity is to be increased in the process of the invention and which is the gene product with an activity as described as a "yjl064w-protein", is increased cytoplasmic.

The sequence of Yjl067w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yjl067w-protein.

Accordingly, in one embodiment, the process of the present invention comprises increasing or generating the activity of a gene product with the activity of a "yjl067w-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yjl067w or a functional equivalent or a homologue thereof as shown in column 7 of table I, application no. 1, preferably a homologue or functional equivalent as shown in column 7 of table I B, application no. 1, and being depicted in the same respective line as said Yjl067w; or (b) a polypeptide comprising a polypeptide, a consensus sequence or a polypeptide motif as shown in column 5 of table II or in column 7 of table IV, application no. 1, respectively, and being depicted in the same respective line as said Yjl067w or a functional equivalent or a homologue thereof as depicted in column 7 of table II, application no. 1, preferably a homologue or functional equivalent as depicted in column 7 of table II B, application no. 1, and being depicted in the same respective line as said Yjl067w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yjl067w-protein", preferably it is the molecule of section (a) or (b) of this paragraph.

In one embodiment, said molecule, which activity is to be increased in the process of the invention and which is the gene product with an activity as described as a "yjl067w-protein", is increased cytoplasmic.

The sequence of Yjl094c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as potassium:hydrogen antiporter.

Accordingly, in one embodiment, the process of the present invention comprises increasing or generating the activity of a gene product with the activity of a "potassium: hydrogen antiporter" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yjl094c or a functional equivalent or a homologue thereof as shown in column 7 of table I, application no. 1, preferably a homologue or functional equivalent as shown in column 7 of table I B, application no. 1, and being depicted in the same respective line as said Yjl094c; or (b) a polypeptide comprising a polypeptide, a consensus sequence or a polypeptide motif as shown in column 5 of table II or in column 7 of table IV, application no. 1, respectively, and being depicted in the same respective line as said Yjl094c or a functional equivalent or a homologue thereof as depicted in column 7 of table II, application no. 1, preferably a homologue or functional equivalent as depicted in column 7 of table II B, application no. 1, and being depicted in the same respective line as said Yjl094c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "potassium: hydrogen antiporter", preferably it is the molecule of section (a) or (b) of this paragraph.

In one embodiment, said molecule, which activity is to be increased in the process of the invention and which is the gene product with an activity as described as a "potassium:hydrogen antiporter", is increased cytoplasmic.

The sequence of Yjl171c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as GPI-anchored cell wall protein.

Accordingly, in one embodiment, the process of the present invention comprises increasing or generating the activity of a gene product with the activity of a "GPI-anchored cell wall protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yjl171c or a functional equivalent or a homologue thereof as shown in column 7 of table I, application no. 1, preferably a homologue or functional equivalent as shown in column 7 of table I B, application no. 1, and being depicted in the same respective line as said Yjl171c; or (b) a polypeptide comprising a polypeptide, a consensus sequence or a polypeptide motif as shown in column 5 of table II or in column 7 of table IV, application no. 1, respectively, and being depicted in the same respective line as said Yjl171c or a functional equivalent or a homologue thereof as depicted in column 7 of table II, application no. 1, preferably a homologue or functional equivalent as depicted in column 7 of table II B, application no. 1, and being depicted in the same respective line as said Yjl171c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "GPI-anchored cell wall protein", preferably it is the molecule of section (a) or (b) of this paragraph.

In one embodiment, said molecule, which activity is to be increased in the process of the invention and which is the gene product with an activity as described as a "GPI-anchored cell wall protein", is increased cytoplasmic.

The sequence of Yjl213w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yjl213w-protein.

Accordingly, in one embodiment, the process of the present invention comprises increasing or generating the activity of a gene product with the activity of a "yjl213w-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yjl213w or a functional equivalent or a homologue thereof as shown in column 7 of table I, application no. 1, preferably a homologue or functional equivalent as shown in column 7 of table I B, application no. 1, and being depicted in the same respective line as said Yjl213w; or
(b) a polypeptide comprising a polypeptide, a consensus sequence or a polypeptide motif as shown in column 5 of table II or in column 7 of table IV, application no. 1, respectively, and being depicted in the same respective line as said Yjl213w or a functional equivalent or a homologue thereof as depicted in column 7 of table II, application no. 1, preferably a homologue or functional equivalent as depicted in column 7 of table II B, application no. 1, and being depicted in the same respective line as said Yjl213w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yjl213w-protein", preferably it is the molecule of section (a) or (b) of this paragraph.

In one embodiment, said molecule, which activity is to be increased in the process of the invention and which is the gene product with an activity as described as a "yjl213w-protein", is increased cytoplasmic.

The sequence of Yjr017c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as peptidyl-prolyl cis-trans isomerase.

Accordingly, in one embodiment, the process of the present invention comprises increasing or generating the activity of a gene product with the activity of a "peptidylprolyl cis-trans isomerase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yjr017c or a functional equivalent or a homologue thereof as shown in column 7 of table I, application no. 1, preferably a homologue or functional equivalent as shown in column 7 of table I B, application no. 1, and being depicted in the same respective line as said Yjr017c; or
(b) a polypeptide comprising a polypeptide, a consensus sequence or a polypeptide motif as shown in column 5 of table II or in column 7 of table IV, application no. 1, respectively, and being depicted in the same respective line as said Yjr017c or a functional equivalent or a homologue thereof as depicted in column 7 of table II, application no. 1, preferably a homologue or functional equivalent as depicted in column 7 of table II B, application no. 1, and being depicted in the same respective line as said Yjr017c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "peptidylprolyl cis-trans isomerase", preferably it is the molecule of section (a) or (b) of this paragraph.

In one embodiment, said molecule, which activity is to be increased in the process of the invention and which is the gene product with an activity as described as a "peptidylprolyl cis-trans isomerase", is increased cytoplasmic.

The sequence of Yjr058c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as clathrin associated protein complex small subunit.

Accordingly, in one embodiment, the process of the present invention comprises increasing or generating the activity of a gene product with the activity of a "clathrin associated protein complex small subunit" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yjr058c or a functional equivalent or a homologue thereof as shown in column 7 of table I, application no. 1, preferably a homologue or functional equivalent as shown in column 7 of table I B, application no. 1, and being depicted in the same respective line as said Yjr058c; or
(b) a polypeptide comprising a polypeptide, a consensus sequence or a polypeptide motif as shown in column 5 of table II or in column 7 of table IV, application no. 1, respectively, and being depicted in the same respective line as said Yjr058c or a functional equivalent or a homologue thereof as depicted in column 7 of table II, application no. 1, preferably a homologue or functional equivalent as depicted in column 7 of table II B, application no. 1, and being depicted in the same respective line as said Yjr058c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "clathrin associated protein complex small subunit", preferably it is the molecule of section (a) or (b) of this paragraph.

In one embodiment, said molecule, which activity is to be increased in the process of the invention and which is the gene product with an activity as described as a "clathrin associated protein complex small subunit", is increased cytoplasmic.

The sequence of Yjr117w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as zinc metalloprotease.

Accordingly, in one embodiment, the process of the present invention comprises increasing or generating the activity of a gene product with the activity of a "zinc metalloprotease" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yjr117w or a functional equivalent or a homologue thereof as shown in column 7 of table I, application no. 1, preferably a homologue or functional equivalent as shown in column 7 of table I B, application no. 1, and being depicted in the same respective line as said Yjr117w; or (b) a polypeptide comprising a polypeptide, a consensus sequence or a polypeptide motif as shown in column 5 of table II or in column 7 of table IV, application no. 1, respectively, and being depicted in the same respective line as said Yjr117w or a functional equivalent or a homologue thereof as depicted in column 7 of table II, application no. 1, preferably a homologue or functional equivalent as depicted in column 7 of table II B, application no. 1, and being depicted in the same respective line as said Yjr117w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "zinc metalloprotease", preferably it is the molecule of section (a) or (b) of this paragraph.

In one embodiment, said molecule, which activity is to be increased in the process of the invention and which is the gene product with an activity as described as a "zinc metalloprotease", is increased cytoplasmic.

The sequence of Yjr121w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as F1F0 ATP synthase beta subunit.

Accordingly, in one embodiment, the process of the present invention comprises increasing or generating the activity of a gene product with the activity of a "F1F0 ATP synthase beta subunit" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yjr121w or a functional equivalent or a homologue thereof as shown in column 7 of table I, application no. 1, preferably a homologue or functional equivalent as shown in column 7 of table I B, application no. 1, and being depicted in the same respective line as said Yjr121w; or (b) a polypeptide comprising a polypeptide, a consensus sequence or a polypeptide motif as shown in column 5 of table II or in column 7 of table IV, application no. 1, respectively, and being depicted in the same respective line as said Yjr121w or a functional equivalent or a homologue thereof as depicted in column 7 of table II, application no. 1, preferably a homologue or functional equivalent as depicted in column 7 of table II B, application no. 1, and being depicted in the same respective line as said Yjr121w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "F1F0 ATP synthase beta subunit", preferably it is the molecule of section (a) or (b) of this paragraph.

In one embodiment, said molecule, which activity is to be increased in the process of the invention and which is the gene product with an activity as described as a "F1F0 ATP synthase beta subunit", is increased cytoplasmic.

The sequence of Yjr131w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as alpha-mannosidase.

Accordingly, in one embodiment, the process of the present invention comprises increasing or generating the activity of a gene product with the activity of a "alpha-mannosidase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yjr131w or a functional equivalent or a homologue thereof as shown in column 7 of table I, application no. 1, preferably a homologue or functional equivalent as shown in column 7 of table I B, application no. 1, and being depicted in the same respective line as said Yjr131w; or (b) a polypeptide comprising a polypeptide, a consensus sequence or a polypeptide motif as shown in column 5 of table II or in column 7 of table IV, application no. 1, respectively, and being depicted in the same respective line as said Yjr131w or a functional equivalent or a homologue thereof as depicted in column 7 of table II, application no.

1, preferably a homologue or functional equivalent as depicted in column 7 of table II B, application no. 1, and being depicted in the same respective line as said Yjr131w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "alpha-mannosidase", preferably it is the molecule of section (a) or (b) of this paragraph.

In one embodiment, said molecule, which activity is to be increased in the process of the invention and which is the gene product with an activity as described as a "alpha-mannosidase", is increased cytoplasmic.

The sequence of Yjr145c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ribosomal protein of the small subunit.

Accordingly, in one embodiment, the process of the present invention comprises increasing or generating the activity of a gene product with the activity of a "ribosomal protein of the small subunit" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yjr145c or a functional equivalent or a homologue thereof as shown in column 7 of table I, application no. 1, preferably a homologue or functional equivalent as shown in column 7 of table I B, application no. 1, and being depicted in the same respective line as said Yjr145c; or
(b) a polypeptide comprising a polypeptide, a consensus sequence or a polypeptide motif as shown in column 5 of table II or in column 7 of table IV, application no. 1, respectively, and being depicted in the same respective line as said Yjr145c or a functional equivalent or a homologue thereof as depicted in column 7 of table II, application no. 1, preferably a homologue or functional equivalent as depicted in column 7 of table II B, application no. 1, and being depicted in the same respective line as said Yjr145c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ribosomal protein of the small subunit", preferably it is the molecule of section (a) or (b) of this paragraph.

In one embodiment, said molecule, which activity is to be increased in the process of the invention and which is the gene product with an activity as described as a "ribosomal protein of the small subunit", is increased cytoplasmic.

The sequence of Ykl084w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as mitochondrial intermembrane space protein.

Accordingly, in one embodiment, the process of the present invention comprises increasing or generating the activity of a gene product with the activity of a "mitochondrial intermembrane space protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ykl084w or a functional equivalent or a homologue thereof as shown in column 7 of table I, application no. 1, preferably a homologue or functional equivalent as shown in column 7 of table I B, application no. 1, and being depicted in the same respective line as said Ykl084w; or
(b) a polypeptide comprising a polypeptide, a consensus sequence or a polypeptide motif as shown in column 5 of table II or in column 7 of table IV, application no. 1, respectively, and being depicted in the same respective line as said Ykl084w or a functional equivalent or a homologue thereof as depicted in column 7 of table II, application no. 1, preferably a homologue or functional equivalent as depicted in column 7 of table II B, application no. 1, and being depicted in the same respective line as said Ykl084w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "mitochondrial intermembrane space protein", preferably it is the molecule of section (a) or (b) of this paragraph.

In one embodiment, said molecule, which activity is to be increased in the process of the invention and which is the gene product with an activity as described as a "mitochondrial intermembrane space protein", is increased cytoplasmic.

The sequence of Ykl088w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as phosphopantothenoylcysteine decarboxylase.

Accordingly, in one embodiment, the process of the present invention comprises increasing or generating the activity of a gene product with the activity of a "phosphopantothenoylcysteine decarboxylase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ykl088w or a functional equivalent or a homologue thereof as shown in column 7 of table I, application no. 1, preferably a homologue or functional equivalent as shown in column 7 of table I B, application no. 1, and being depicted in the same respective line as said Ykl088w; or (b) a polypeptide comprising a polypeptide, a consensus sequence or a polypeptide motif as shown in column 5 of table II or in column 7 of table IV, application no. 1, respectively, and being depicted in the same respective line as said Ykl088w or a functional equivalent or a homologue thereof as depicted in column 7 of table II, application no. 1, preferably a homologue or functional equivalent as depicted in column 7 of table II B, application no. 1, and being depicted in the same respective line as said Ykl088w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "phosphopantothenoylcysteine decarboxylase", preferably it is the molecule of section (a) or (b) of this paragraph.

In one embodiment, said molecule, which activity is to be increased in the process of the invention and which is the gene product with an activity as described as a "phosphopantothenoylcysteine decarboxylase", is increased cytoplasmic.

The sequence of Ykl100c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ykl100c-protein.

Accordingly, in one embodiment, the process of the present invention comprises increasing or generating the activity of a gene product with the activity of a "ykl100c-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykl100c or a functional equivalent or a homologue thereof as shown in column 7 of table I, application no. 1, preferably a homologue or functional equivalent as shown in column 7 of table I B, application no. 1, and being depicted in the same respective line as said Ykl100c; or (b) a polypeptide comprising a polypeptide, a consensus sequence or a polypeptide motif as shown in column 5 of table II or in column 7 of table IV, application no. 1, respectively, and being depicted in the same respective line as said Ykl100c or a functional equivalent or a homologue thereof as depicted in column 7 of table II, application no. 1, preferably a homologue or functional equivalent as depicted in column 7 of table II B, application no. 1, and being depicted in the same respective line as said Ykl100c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ykl100c-protein", preferably it is the molecule of section (a) or (b) of this paragraph.

In one embodiment, said molecule, which activity is to be increased in the process of the invention and which is the gene product with an activity as described as a "ykl100c-protein", is increased cytoplasmic.

The sequence of Ykl131w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ykl131w-protein.

Accordingly, in one embodiment, the process of the present invention comprises increasing or generating the activity of a gene product with the activity of a "ykl131w-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykl131w or a functional equivalent or a homologue thereof as shown in column 7 of table I, application no. 1, preferably a homologue or functional equivalent as shown in column 7 of table I B, application no. 1, and being depicted in the same respective line as said Ykl131w; or (b) a polypeptide comprising a polypeptide, a consensus sequence or a polypeptide motif as shown in column 5 of table II or in column 7 of table IV, application no. 1, respectively, and being depicted in the same respective line as said Ykl131w or a functional equivalent or a homologue thereof as depicted in column 7 of table II, application no. 1, preferably a homologue or functional equivalent as depicted in column 7 of table II B, application no. 1, and being depicted in the same respective line as said Ykl131w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ykl131w-protein", preferably it is the molecule of section (a) or (b) of this paragraph.

In one embodiment, said molecule, which activity is to be increased in the process of the invention and which is the gene product with an activity as described as a "ykl131w-protein", is increased cytoplasmic.

The sequence of Ykl138c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as mitochondrial ribosomal protein of the large subunit.

Accordingly, in one embodiment, the process of the present invention comprises increasing or generating the activity of a gene product with the activity of a "mitochondrial ribosomal protein of the large subunit" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykl138c or a functional equivalent or a homologue thereof as shown in column 7 of table I, application no. 1, preferably a homologue or functional equivalent as shown in column 7 of table I B, application no. 1, and being depicted in the same respective line as said Ykl138c; or
(b) a polypeptide comprising a polypeptide, a consensus sequence or a polypeptide motif as shown in column 5 of table II or in column 7 of table IV, application no. 1, respectively, and being depicted in the same respective line as said Ykl138c or a functional equivalent or a homologue thereof as depicted in column 7 of table II, application no. 1, preferably a homologue or functional equivalent as depicted in column 7 of table II B, application no. 1, and being depicted in the same respective line as said Ykl138c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "mitochondrial ribosomal protein of the large subunit", preferably it is the molecule of section (a) or (b) of this paragraph.

In one embodiment, said molecule, which activity is to be increased in the process of the invention and which is the gene product with an activity as described as a "mitochondrial ribosomal protein of the large subunit", is increased cytoplasmic.

The sequence of Ykl178c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as G protein coupled pheromone receptor receptor.

Accordingly, in one embodiment, the process of the present invention comprises increasing or generating the activity of a gene product with the activity of a "G protein coupled pheromone receptor receptor" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ykl178c or a functional equivalent or a homologue thereof as shown in column 7 of table I, application no. 1, preferably a homologue or functional equivalent as shown in column 7 of table I B, application no. 1, and being depicted in the same respective line as said Ykl178c; or
(b) a polypeptide comprising a polypeptide, a consensus sequence or a polypeptide motif as shown in column 5 of table II or in column 7 of table IV, application no. 1, respectively, and being depicted in the same respective line as said Ykl178c or a functional equivalent or a homologue thereof as depicted in column 7 of table II, application no. 1, preferably a homologue or functional equivalent as depicted in column 7 of table II B, application no. 1, and being depicted in the same respective line as said Ykl178c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "G protein coupled pheromone receptor receptor", preferably it is the molecule of section (a) or (b) of this paragraph.

In one embodiment, said molecule, which activity is to be increased in the process of the invention and which is the gene product with an activity as described as a "G protein coupled pheromone receptor receptor", is increased cytoplasmic.

The sequence of Ykl179c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as golgi membrane protein.

Accordingly, in one embodiment, the process of the present invention comprises increasing or generating the activity of a gene product with the activity of a "golgi membrane protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ykl179c or a functional equivalent or a homologue thereof as shown in column 7 of table I, application no. 1, preferably a homologue or functional equivalent as shown in column 7 of table I B, application no. 1, and being depicted in the same respective line as said Ykl179c; or
(b) a polypeptide comprising a polypeptide, a consensus sequence or a polypeptide motif as shown in column 5 of table II or in column 7 of table IV, application no. 1, respectively, and being depicted in the same respective line as said Ykl179c or a functional equivalent or a homologue thereof as depicted in column 7 of table II, application no. 1, preferably a homologue or functional equivalent as depicted in column 7 of table II B, application no. 1, and being depicted in the same respective line as said Ykl179c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "golgi membrane protein", preferably it is the molecule of section (a) or (b) of this paragraph.

In one embodiment, said molecule, which activity is to be increased in the process of the invention and which is the gene product with an activity as described as a "golgi membrane protein", is increased cytoplasmic.

The sequence of Ykl193c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as regulatory subunit of Glc7p type 1 protein serine-threonine phosphatase.

Accordingly, in one embodiment, the process of the present invention comprises increasing or generating the activity of a gene product with the activity of a "regulatory subunit of Glc7p type 1 protein serine-threonine phosphatase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ykl193c or a functional equivalent or a homologue thereof as shown in column 7 of table I, application no. 1, preferably a homologue or functional equivalent as shown in column 7 of table I B, application no. 1, and being depicted in the same respective line as said Ykl193c; or
(b) a polypeptide comprising a polypeptide, a consensus sequence or a polypeptide motif as shown in column 5 of table II or in column 7 of table IV, application no. 1, respectively, and being depicted in the same respective line as said Ykl193c or a functional equivalent or a homologue thereof as depicted in column 7 of table II, application no. 1, preferably a homologue or functional equivalent as depicted in column 7 of table II B, application no. 1, and being depicted in the same respective line as said Ykl193c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "regulatory subunit of Glc7p type 1 protein serine-threonine phosphatase", preferably it is the molecule of section (a) or (b) of this paragraph.

In one embodiment, said molecule, which activity is to be increased in the process of the invention and which is the gene product with an activity as described as a "regulatory subunit of Glc7p type 1 protein serine-threonine phosphatase", is increased cytoplasmic.

The sequence of Ykl216w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as dihydroorotate dehydrogenase.

Accordingly, in one embodiment, the process of the present invention comprises increasing or generating the activity of a gene product with the activity of a "dihydroorotate dehydrogenase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ykl216w or a functional equivalent or a homologue thereof as shown in column 7 of table I, application no. 1, preferably a homologue or functional equivalent as shown in column 7 of table I B, application no. 1, and being depicted in the same respective line as said Ykl216w; or
(b) a polypeptide comprising a polypeptide, a consensus sequence or a polypeptide motif as shown in column 5 of table II or in column 7 of table IV, application no. 1, respectively, and being depicted in the same respective line as said Ykl216w or a functional equivalent or a homologue thereof as depicted in column 7 of table II, application no. 1, preferably a homologue or functional equivalent as depicted in column 7 of table II B, application no. 1, and being depicted in the same respective line as said Ykl216w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "dihydroorotate dehydrogenase", preferably it is the molecule of section (a) or (b) of this paragraph.

In one embodiment, said molecule, which activity is to be increased in the process of the invention and which is the gene product with an activity as described as a "dihydroorotate dehydrogenase", is increased cytoplasmic.

The sequence of Ykr016w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ykr016w-protein.

Accordingly, in one embodiment, the process of the present invention comprises increasing or generating the activity of a gene product with the activity of a "ykr016w-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ykr016w or a functional equivalent or a homologue thereof as shown in column 7 of table I, application no. 1, preferably a homologue or functional equivalent as shown in column 7 of table I B, application no. 1, and being depicted in the same respective line as said Ykr016w; or
(b) a polypeptide comprising a polypeptide, a consensus sequence or a polypeptide motif as shown in column 5 of table II or in column 7 of table IV, application no. 1, respectively, and being depicted in the same respective line as said Ykr016w or a functional equivalent or a homologue thereof as depicted in column 7 of table II, application no. 1, preferably a homologue or functional equivalent as depicted in column 7 of table II B, application no. 1, and being depicted in the same respective line as said Ykr016w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ykr016w-protein", preferably it is the molecule of section (a) or (b) of this paragraph.

In one embodiment, said molecule, which activity is to be increased in the process of the invention and which is the gene product with an activity as described as a "ykr016w-protein", is increased cytoplasmic.

The sequence of Ykr021w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ykr021w-protein.

Accordingly, in one embodiment, the process of the present invention comprises increasing or generating the activity of a gene product with the activity of a "ykr021w-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykr021w or a functional equivalent or a homologue thereof as shown in column 7 of table I, application no. 1, preferably a homologue or functional equivalent as shown in column 7 of table I B, application no. 1, and being depicted in the same respective line as said Ykr021w; or (b) a polypeptide comprising a polypeptide, a consensus sequence or a polypeptide motif as shown in column 5 of table II or in column 7 of table IV, application no. 1, respectively, and being depicted in the same respective line as said Ykr021w or a functional equivalent or a homologue thereof as depicted in column 7 of table II, application no. 1, preferably a homologue or functional equivalent as depicted in column 7 of table II B, application no. 1, and being depicted in the same respective line as said Ykr021w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ykr021w-protein", preferably it is the molecule of section (a) or (b) of this paragraph.

In one embodiment, said molecule, which activity is to be increased in the process of the invention and which is the gene product with an activity as described as a "ykr021w-protein", is increased cytoplasmic.

The sequence of Ykr055w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as non-essential small GTPase of the Rho/Rac subfamily of Ras-like proteins.

Accordingly, in one embodiment, the process of the present invention comprises increasing or generating the activity of a gene product with the activity of a "non-essential small GTPase of the Rho/Rac subfamily of Ras-like proteins" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykr055w or a functional equivalent or a homologue thereof as shown in column 7 of table I, application no. 1, preferably a homologue or functional equivalent as shown in column 7 of table I B, application no. 1, and being depicted in the same respective line as said Ykr055w; or (b) a polypeptide comprising a polypeptide, a consensus sequence or a polypeptide motif as shown in column 5 of table II or in column 7 of table IV, application no. 1, respectively, and being depicted in the same respective line as said Ykr055w or a functional equivalent or a homologue thereof as depicted in column 7 of table II, application no. 1, preferably a homologue or functional equivalent as depicted in column 7 of table II B, application no. 1, and being depicted in the same respective line as said Ykr055w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "non-essential small GTPase of the Rho/Rac subfamily of Ras-like proteins", preferably it is the molecule of section (a) or (b) of this paragraph.

In one embodiment, said molecule, which activity is to be increased in the process of the invention and which is the gene product with an activity as described as a "non-essential small GTPase of the Rho/Rac subfamily of Ras-like proteins", is increased cytoplasmic.

The sequence of Ykr088c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as integral membrane protein localized to late Golgi vesicles.

Accordingly, in one embodiment, the process of the present invention comprises increasing or generating the activity of a gene product with the activity of a "integral membrane protein localized to late Golgi vesicles" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykr088c or a functional equivalent or a homologue thereof as shown in column 7 of table I, application no. 1, preferably a homologue or functional equivalent as shown in column 7 of table I B, application no. 1, and being depicted in the same respective line as said Ykr088c; or (b) a polypeptide comprising a polypeptide, a consensus sequence or a polypeptide motif as shown in column 5 of table II or in column 7 of table IV, application no. 1, respectively, and being depicted in the same respective line as said Ykr088c or a functional equivalent or a homologue thereof as depicted in column 7 of table II, application no. 1, preferably a homologue or functional equivalent as depicted in column 7 of table II B, application no. 1, and being depicted in the same respective line as said Ykr088c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "integral membrane protein localized to late Golgi vesicles", preferably it is the molecule of section (a) or (b) of this paragraph.

In one embodiment, said molecule, which activity is to be increased in the process of the invention and which is the gene product with an activity as described as a "integral membrane protein localized to late Golgi vesicles", is increased plastidic.

The sequence of Ykr093w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as peptide transporter.

Accordingly, in one embodiment, the process of the present invention comprises increasing or generating the activity of a gene product with the activity of a "peptide transporter" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykr093w or a functional equivalent or a homologue thereof as shown in column 7 of table I, application no. 1, preferably a homologue or functional equivalent as shown in column 7 of table I B, application no. 1, and being depicted in the same respective line as said Ykr093w; or (b) a polypeptide comprising a polypeptide, a consensus sequence or a polypeptide motif as shown in column 5 of table II or in column 7 of table IV, application no. 1, respectively, and being depicted in the same respective line as said Ykr093w or a functional equivalent or a homologue thereof as depicted in column 7 of table II, application no. 1, preferably a homologue or functional equivalent as depicted in column 7 of table II B, application no. 1, and being depicted in the same respective line as said Ykr093w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "peptide transporter", preferably it is the molecule of section (a) or (b) of this paragraph.

In one embodiment, said molecule, which activity is to be increased in the process of the invention and which is the gene product with an activity as described as a "peptide transporter", is increased cytoplasmic.

The sequence of Ykr099w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as transcription factor.

Accordingly, in one embodiment, the process of the present invention comprises increasing or generating the activity of a gene product with the activity of a "transcription factor" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykr099w or a functional equivalent or a homologue thereof as shown in column 7 of table I, application no. 1, preferably a homologue or functional equivalent as shown in column 7 of table I B, application no. 1, and being depicted in the same respective line as said Ykr099w; or (b) a polypeptide comprising a polypeptide, a consensus sequence or a polypeptide motif as shown in column 5 of table II or in column 7 of table IV, application no. 1, respectively, and being depicted in the same respective line as said Ykr099w or a functional equivalent or a homologue thereof as depicted in column 7 of table II, application no. 1, preferably a homologue or functional equivalent as depicted in column 7 of table II B, application no. 1, and being depicted in the same respective line as said Ykr099w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "transcription factor", preferably it is the molecule of section (a) or (b) of this paragraph.

In one embodiment, said molecule, which activity is to be increased in the process of the invention and which is the gene product with an activity as described as a "transcription factor", is increased cytoplasmic.

The sequence of Ykr100c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as transmembrane protein with a role in cell wall polymer composition.

Accordingly, in one embodiment, the process of the present invention comprises increasing or generating the activity of a gene product with the activity of a "transmembrane protein with a role in cell wall polymer composition" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykr100c or a functional equivalent or a homologue thereof as shown in column 7 of table I, application no. 1, preferably a homologue or functional equivalent as shown in column 7 of table I B, application no. 1, and being depicted in the same respective line as said Ykr100c; or (b) a polypeptide comprising a polypeptide, a consensus sequence or a polypeptide motif as shown in column 5 of table II or in column 7 of table IV, application no. 1, respectively, and being depicted in the same respective line as said Ykr100c or a functional equivalent or a homologue thereof as depicted in column 7 of table II, application no. 1, preferably a homologue or functional equivalent as depicted in column 7 of table II B, application no. 1, and being depicted in the same respective line as said Ykr100c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "trans-membrane protein with a role in cell wall polymer composition", preferably it is the molecule of section (a) or (b) of this paragraph.

In one embodiment, said molecule, which activity is to be increased in the process of the invention and which is the gene product with an activity as described as a "transmembrane protein with a role in cell wall polymer composition", is increased cytoplasmic.

The sequence of Yll014w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yll014w-protein.

Accordingly, in one embodiment, the process of the present invention comprises increasing or generating the activity of a gene product with the activity of a "yll014w-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yll014w or a functional equivalent or a homologue thereof as shown in column 7 of table I, application no. 1, preferably a homologue or functional equivalent as shown in column 7 of table I B, application no. 1, and being depicted in the same respective line as said Yll014w; or
(b) a polypeptide comprising a polypeptide, a consensus sequence or a polypeptide motif as shown in column 5 of table II or in column 7 of table IV, application no. 1, respectively, and being depicted in the same respective line as said Yll014w or a functional equivalent or a homologue thereof as depicted in column 7 of table II, application no. 1, preferably a homologue or functional equivalent as depicted in column 7 of table II B, application no. 1, and being depicted in the same respective line as said Yll014w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yll014w-protein", preferably it is the molecule of section (a) or (b) of this paragraph.

In one embodiment, said molecule, which activity is to be increased in the process of the invention and which is the gene product with an activity as described as a "yll014w-protein", is increased cytoplasmic.

The sequence of Yll016w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as non-essential Ras guanine nucleotide exchange factor.

Accordingly, in one embodiment, the process of the present invention comprises increasing or generating the activity of a gene product with the activity of a "non-essential Ras guanine nucleotide exchange factor" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yll016w or a functional equivalent or a homologue thereof as shown in column 7 of table I, application no. 1, preferably a homologue or functional equivalent as shown in column 7 of table I B, application no. 1, and being depicted in the same respective line as said Yll016w; or
(b) a polypeptide comprising a polypeptide, a consensus sequence or a polypeptide motif as shown in column 5 of table II or in column 7 of table IV, application no. 1, respectively, and being depicted in the same respective line as said Yll016w or a functional equivalent or a homologue thereof as depicted in column 7 of table II, application no. 1, preferably a homologue or functional equivalent as depicted in column 7 of table II B, application no. 1, and being depicted in the same respective line as said Yll016w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "non-essential Ras guanine nucleotide exchange factor", preferably it is the molecule of section (a) or (b) of this paragraph.

In one embodiment, said molecule, which activity is to be increased in the process of the invention and which is the gene product with an activity as described as a "non-essential Ras guanine nucleotide exchange factor", is increased cytoplasmic.

The sequence of Yll023c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yll023c-protein.

Accordingly, in one embodiment, the process of the present invention comprises increasing or generating the activity of a gene product with the activity of a "yll023c-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yll023c or a functional equivalent or a homologue thereof as shown in column 7 of table I, application no. 1, preferably a homologue or functional equivalent as shown in column 7 of table I B, application no. 1, and being depicted in the same respective line as said Yll023c; or
(b) a polypeptide comprising a polypeptide, a consensus sequence or a polypeptide motif as shown in column 5 of table II or in column 7 of table IV, application no. 1, respectively, and being depicted in the same respective line as said Yll023c or a functional equivalent or a homologue thereof as depicted in column 7 of table II, application no. 1, preferably a homologue or functional equivalent as depicted in column 7 of table II B, application no. 1, and being depicted in the same respective line as said Yll023c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yll023c-protein", preferably it is the molecule of section (a) or (b) of this paragraph.

In one embodiment, said molecule, which activity is to be increased in the process of the invention and which is the gene product with an activity as described as a "yll023c-protein", is increased cytoplasmic.

The sequence of Yll037w from Saccharomyces cerevisiae, e.g. as shown in column 5 of table I, application no. 1, is published (e.g. sequences from Saccharomyces cerevisiae have been published in Goffeau et al., Science 274 (5287), 546 (1996), sequences from Escherichia coli have been published in Blattner et al., Science 277 (5331), 1453 (1997)), and/or its activity is described as yll037w-protein.

Accordingly, in one embodiment, the process of the present invention comprises increasing or generating the activity of a gene product with the activity of a "yll037w-protein" from Saccharomyces cerevisiae or its functional equivalent or its homolog, e.g. the increase of
(a) a gene product of a gene comprising the nucleic acid molecule as shown in column 5 of table I, application no. 1, and being depicted in the same respective line as said Yll037w or a functional equivalent or a homologue thereof as shown in column 7 of table I, application no. 1, preferably a homologue or functional equivalent as shown in column 7 of table I B, application no. 1, and being depicted in the same respective line as said Yll037w; or
(b) a polypeptide comprising a polypeptide, a consensus sequence or a polypeptide motif as shown in column 5 of table II or in column 7 of table IV, application no. 1, respectively, and being depicted in the same respective line as said Yll037w or a functional equivalent or a homologue thereof as depicted in column 7 of table II, application no. 1, preferably a homologue or functional equivalent as depicted in column 7 of table II B, application no. 1, and being depicted in the same respective line as said Yll037w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yll037w-protein", preferably it is the molecule of section (a) or (b) of this paragraph.

In one embodiment, said molecule, which activity is to be increased in the process of the invention and which is the gene product with an activity as described as a "yll037w-protein", is increased cytoplasmic.

The sequence of Yll049w from Saccharomyces cerevisiae, e.g. as shown in column 5 of table I, application no. 1, is published (e.g. sequences from Saccharomyces cerevisiae have been published in Goffeau et al., Science 274 (5287), 546 (1996), sequences from Escherichia coli have been published in Blattner et al., Science 277 (5331), 1453 (1997)), and/or its activity is described as yll049w-protein.

Accordingly, in one embodiment, the process of the present invention comprises increasing or generating the activity of a gene product with the activity of a "yll049w-protein" from Saccharomyces cerevisiae or its functional equivalent or its homolog, e.g. the increase of
(a) a gene product of a gene comprising the nucleic acid molecule as shown in column 5 of table I, application no. 1, and being depicted in the same respective line as said Yll049w or a functional equivalent or a homologue thereof as shown in column 7 of table I, application no. 1, preferably a homologue or functional equivalent as shown in column 7 of table I B, application no. 1, and being depicted in the same respective line as said Yll049w; or
(b) a polypeptide comprising a polypeptide, a consensus sequence or a polypeptide motif as shown in column 5 of table II or in column 7 of table IV, application no. 1, respectively, and being depicted in the same respective line as said Yll049w or a functional equivalent or a homologue thereof as depicted in column 7 of table II, application no. 1, preferably a homologue or functional equivalent as depicted in column 7 of table II B, application no. 1, and being depicted in the same respective line as said Yll049w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yll049w-protein", preferably it is the molecule of section (a) or (b) of this paragraph.

In one embodiment, said molecule, which activity is to be increased in the process of the invention and which is the gene product with an activity as described as a "yll049w-protein", is increased cytoplasmic.

The sequence of Yll055w from Saccharomyces cerevisiae, e.g. as shown in column 5 of table I, application no. 1, is published (e.g. sequences from Saccharomyces cerevisiae have been published in Goffeau et al., Science 274 (5287), 546 (1996), sequences from Escherichia coli have been published in Blattner et al., Science 277 (5331), 1453 (1997)), and/or its activity is described as cysteine transporter.

Accordingly, in one embodiment, the process of the present invention comprises increasing or generating the activity of a gene product with the activity of a "cysteine transporter" from Saccharomyces cerevisiae or its functional equivalent or its homolog, e.g. the increase of
(a) a gene product of a gene comprising the nucleic acid molecule as shown in column 5 of table I, application no. 1, and being depicted in the same respective line as said Yll055w or a functional equivalent or a homologue thereof as shown in column 7 of table I, application no. 1, preferably a homologue or functional equivalent as shown in column 7 of table I B, application no. 1, and being depicted in the same respective line as said Yll055w; or
(b) a polypeptide comprising a polypeptide, a consensus sequence or a polypeptide motif as shown in column 5 of table II or in column 7 of table IV, application no. 1, respectively, and being depicted in the same respective line as said Yll055w or a functional equivalent or a homologue thereof as depicted in column 7 of table II, application no. 1, preferably a homologue or functional equivalent as depicted in column 7 of table II B, application no. 1, and being depicted in the same respective line as said Yll055w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "cysteine transporter", preferably it is the molecule of section (a) or (b) of this paragraph.

In one embodiment, said molecule, which activity is to be increased in the process of the invention and which is the gene product with an activity as described as a "cysteine transporter", is increased cytoplasmic.

The sequence of Ylr034c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as metal ion transporter.

Accordingly, in one embodiment, the process of the present invention comprises increasing or generating the activity of a gene product with the activity of a "metal ion transporter" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr034c or a functional equivalent or a homologue thereof as shown in column 7 of table I, application no. 1, preferably a homologue or functional equivalent as shown in column 7 of table I B, application no. 1, and being depicted in the same respective line as said Ylr034c; or
(b) a polypeptide comprising a polypeptide, a consensus sequence or a polypeptide motif as shown in column 5 of table II or in column 7 of table IV, application no. 1, respectively, and being depicted in the same respective line as said Ylr034c or a functional equivalent or a homologue thereof as depicted in column 7 of table II, application no. 1, preferably a homologue or functional equivalent as depicted in column 7 of table II B, application no. 1, and being depicted in the same respective line as said Ylr034c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "metal ion transporter", preferably it is the molecule of section (a) or (b) of this paragraph.

In one embodiment, said molecule, which activity is to be increased in the process of the invention and which is the gene product with an activity as described as a "metal ion transporter", is increased cytoplasmic.

The sequence of Ylr042c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ylr042c-protein.

Accordingly, in one embodiment, the process of the present invention comprises increasing or generating the activity of a gene product with the activity of a "ylr042c-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr042c or a functional equivalent or a homologue thereof as shown in column 7 of table I, application no. 1, preferably a homologue or functional equivalent as shown in column 7 of table I B, application no. 1, and being depicted in the same respective line as said Ylr042c; or
(b) a polypeptide comprising a polypeptide, a consensus sequence or a polypeptide motif as shown in column 5 of table II or in column 7 of table IV, application no. 1, respectively, and being depicted in the same respective line as said Ylr042c or a functional equivalent or a homologue thereof as depicted in column 7 of table II, application no. 1, preferably a homologue or functional equivalent as depicted in column 7 of table II B, application no. 1, and being depicted in the same respective line as said Ylr042c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ylr042c-protein", preferably it is the molecule of section (a) or (b) of this paragraph.

In one embodiment, said molecule, which activity is to be increased in the process of the invention and which is the gene product with an activity as described as a "ylr042c-protein", is increased cytoplasmic.

The sequence of Ylr053c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YLR053c-protein.

Accordingly, in one embodiment, the process of the present invention comprises increasing or generating the activity of a gene product with the activity of a "YLR053c-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr053c or a functional equivalent or a homologue thereof as shown in column 7 of table I, application no. 1, preferably a homologue or functional equivalent as shown in column 7 of table I B, application no. 1, and being depicted in the same respective line as said Ylr053c; or
(b) a polypeptide comprising a polypeptide, a consensus sequence or a polypeptide motif as shown in column 5 of table II or in column 7 of table IV, application no. 1, respectively, and being depicted in the same respective line as said Ylr053c or a functional equivalent or a homologue thereof as depicted in column 7 of table II, application no.

1, preferably a homologue or functional equivalent as depicted in column 7 of table II B, application no. 1, and being depicted in the same respective line as said Ylr053c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YLR053c-protein", preferably it is the molecule of section (a) or (b) of this paragraph.

In one embodiment, said molecule, which activity is to be increased in the process of the invention and which is the gene product with an activity as described as a "YLR053c-protein", is increased cytoplasmic.

The sequence of Ylr058c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as cytosolic serine hydroxymethyltransferase.

Accordingly, in one embodiment, the process of the present invention comprises increasing or generating the activity of a gene product with the activity of a "cytosolic serine hydroxymethyltransferase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr058c or a functional equivalent or a homologue thereof as shown in column 7 of table I, application no. 1, preferably a homologue or functional equivalent as shown in column 7 of table I B, application no. 1, and being depicted in the same respective line as said Ylr058c; or
(b) a polypeptide comprising a polypeptide, a consensus sequence or a polypeptide motif as shown in column 5 of table II or in column 7 of table IV, application no. 1, respectively, and being depicted in the same respective line as said Ylr058c or a functional equivalent or a homologue thereof as depicted in column 7 of table II, application no. 1, preferably a homologue or functional equivalent as depicted in column 7 of table II B, application no. 1, and being depicted in the same respective line as said Ylr058c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "cytosolic serine hydroxymethyltransferase", preferably it is the molecule of section (a) or (b) of this paragraph.

In one embodiment, said molecule, which activity is to be increased in the process of the invention and which is the gene product with an activity as described as a "cytosolic serine hydroxymethyltransferase", is increased cytoplasmic.

The sequence of Ylr060w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as subunit of cytoplasmic phenylalanyl-tRNA synthetase.

Accordingly, in one embodiment, the process of the present invention comprises increasing or generating the activity of a gene product with the activity of a "subunit of cytoplasmic phenylalanyl-tRNA synthetase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr060w or a functional equivalent or a homologue thereof as shown in column 7 of table I, application no. 1, preferably a homologue or functional equivalent as shown in column 7 of table I B, application no. 1, and being depicted in the same respective line as said Ylr060w; or
(b) a polypeptide comprising a polypeptide, a consensus sequence or a polypeptide motif as shown in column 5 of table II or in column 7 of table IV, application no. 1, respectively, and being depicted in the same respective line as said Ylr060w or a functional equivalent or a homologue thereof as depicted in column 7 of table II, application no. 1, preferably a homologue or functional equivalent as depicted in column 7 of table II B, application no. 1, and being depicted in the same respective line as said Ylr060w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "subunit of cytoplasmic phenylalanyl-tRNA synthetase", preferably it is the molecule of section (a) or (b) of this paragraph.

In one embodiment, said molecule, which activity is to be increased in the process of the invention and which is the gene product with an activity as described as a "subunit of cytoplasmic phenylalanyl-tRNA synthetase", is increased cytoplasmic.

The sequence of Ylr065c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ylr065c-protein.

Accordingly, in one embodiment, the process of the present invention comprises increasing or generating the activity of a gene product with the activity of a "ylr065c-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr065c or a functional equivalent or a homologue thereof as shown in column 7 of table I, application no. 1, preferably a homologue or functional equivalent as shown in column 7 of table I B, application no. 1, and being depicted in the same respective line as said Ylr065c; or
(b) a polypeptide comprising a polypeptide, a consensus sequence or a polypeptide motif as shown in column 5 of table II or in column 7 of table IV, application no. 1, respectively, and being depicted in the same respective line as said Ylr065c or a functional equivalent or a homologue thereof as depicted in column 7 of table II, application no. 1, preferably a homologue or functional equivalent as depicted in column 7 of table II B, application no. 1, and being depicted in the same respective line as said Ylr065c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ylr065c-protein", preferably it is the molecule of section (a) or (b) of this paragraph.

In one embodiment, said molecule, which activity is to be increased in the process of the invention and which is the gene product with an activity as described as a "ylr065c-protein", is increased cytoplasmic.

The sequence of Ylr070c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as xylitol dehydrogenase.

Accordingly, in one embodiment, the process of the present invention comprises increasing or generating the activity of a gene product with the activity of a "xylitol dehydrogenase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr070c or a functional equivalent or a homologue thereof as shown in column 7 of table I, application no. 1, preferably a homologue or functional equivalent as shown in column 7 of table I B, application no. 1, and being depicted in the same respective line as said Ylr070c; or
(b) a polypeptide comprising a polypeptide, a consensus sequence or a polypeptide motif as shown in column 5 of table II or in column 7 of table IV, application no. 1, respectively, and being depicted in the same respective line as said Ylr070c or a functional equivalent or a homologue thereof as depicted in column 7 of table II, application no. 1, preferably a homologue or functional equivalent as depicted in column 7 of table II B, application no. 1, and being depicted in the same respective line as said Ylr070c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "xylitol dehydrogenase", preferably it is the molecule of section (a) or (b) of this paragraph.

In one embodiment, said molecule, which activity is to be increased in the process of the invention and which is the gene product with an activity as described as a "xylitol dehydrogenase", is increased cytoplasmic.

The sequence of Ylr100w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as 3-keto sterol reductase.

Accordingly, in one embodiment, the process of the present invention comprises increasing or generating the activity of a gene product with the activity of a "3-keto sterol reductase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr100w or a functional equivalent or a homologue thereof as shown in column 7 of table I, application no. 1, preferably a homologue or functional equivalent as shown in column 7 of table I B, application no. 1, and being depicted in the same respective line as said Ylr100w; or
(b) a polypeptide comprising a polypeptide, a consensus sequence or a polypeptide motif as shown in column 5 of table II or in column 7 of table IV, application no. 1, respectively, and being depicted in the same respective line as said Ylr100w or a functional equivalent or a homologue thereof as depicted in column 7 of table II, application no. 1, preferably a homologue or functional equivalent as depicted in column 7 of table II B, application no. 1, and being depicted in the same respective line as said Ylr100w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "3-keto sterol reductase", preferably it is the molecule of section (a) or (b) of this paragraph.

In one embodiment, said molecule, which activity is to be increased in the process of the invention and which is the gene product with an activity as described as a "3-keto sterol reductase", is increased cytoplasmic.

The sequence of Ylr109w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as alkyl hydroperoxide reductase.

Accordingly, in one embodiment, the process of the present invention comprises increasing or generating the activity of a gene product with the activity of a "alkyl hydroperoxide reductase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr109w or a functional equivalent or a homologue thereof as shown in column 7 of table I, application no. 1, preferably a homologue or functional equivalent as shown in column 7 of table I B, application no. 1, and being depicted in the same respective line as said Ylr109w; or (b) a polypeptide comprising a polypeptide, a consensus sequence or a polypeptide motif as shown in column 5 of table II or in column 7 of table IV, application no. 1, respectively, and being depicted in the same respective line as said Ylr109w or a functional equivalent or a homologue thereof as depicted in column 7 of table II, application no. 1, preferably a homologue or functional equivalent as depicted in column 7 of table II B, application no. 1, and being depicted in the same respective line as said Ylr109w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "alkyl hydroperoxide reductase", preferably it is the molecule of section (a) or (b) of this paragraph.

In one embodiment, said molecule, which activity is to be increased in the process of the invention and which is the gene product with an activity as described as a "alkyl hydroperoxide reductase", is increased cytoplasmic.

The sequence of Ylr125w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ylr125w-protein.

Accordingly, in one embodiment, the process of the present invention comprises increasing or generating the activity of a gene product with the activity of a "ylr125w-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ylr125w or a functional equivalent or a homologue thereof as shown in column 7 of table I, application no. 1, preferably a homologue or functional equivalent as shown in column 7 of table I B, application no. 1, and being depicted in the same respective line as said Ylr125w; or (b) a polypeptide comprising a polypeptide, a consensus sequence or a polypeptide motif as shown in column 5 of table II or in column 7 of table IV, application no. 1, respectively, and being depicted in the same respective line as said Ylr125w or a functional equivalent or a homologue thereof as depicted in column 7 of table II, application no. 1, preferably a homologue or functional equivalent as depicted in column 7 of table II B, application no. 1, and being depicted in the same respective line as said Ylr125w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ylr125w-protein", preferably it is the molecule of section (a) or (b) of this paragraph.

In one embodiment, said molecule, which activity is to be increased in the process of the invention and which is the gene product with an activity as described as a "ylr125w-protein", is increased cytoplasmic.

The sequence of Ylr127c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as anaphase promoting complex (APC) subunit.

Accordingly, in one embodiment, the process of the present invention comprises increasing or generating the activity of a gene product with the activity of a "anaphase promoting complex (APC) subunit" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ylr127c or a functional equivalent or a homologue thereof as shown in column 7 of table I, application no. 1, preferably a homologue or functional equivalent as shown in column 7 of table I B, application no. 1, and being depicted in the same respective line as said Ylr127c; or (b) a polypeptide comprising a polypeptide, a consensus sequence or a polypeptide motif as shown in column 5 of table II or in column 7 of table IV, application no. 1, respectively, and being depicted in the same respective line as said Ylr127c or a functional equivalent or a homologue thereof as depicted in column 7 of table II, application no. 1, preferably a homologue or functional equivalent as depicted in column 7 of table II B, application no. 1, and being depicted in the same respective line as said Ylr127c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "anaphase promoting complex (APC) subunit", preferably it is the molecule of section (a) or (b) of this paragraph.

In one embodiment, said molecule, which activity is to be increased in the process of the invention and which is the gene product with an activity as described as a "anaphase promoting complex (APC) subunit", is increased cytoplasmic.

The sequence of Ylr185w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as protein component of the large ribosomal subunit.

Accordingly, in one embodiment, the process of the present invention comprises increasing or generating the activity of a gene product with the activity of a "protein component of the large ribosomal subunit" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr185w or a functional equivalent or a homologue thereof as shown in column 7 of table I, application no. 1, preferably a homologue or functional equivalent as shown in column 7 of table I B, application no. 1, and being depicted in the same respective line as said Ylr185w; or
(b) a polypeptide comprising a polypeptide, a consensus sequence or a polypeptide motif as shown in column 5 of table II or in column 7 of table IV, application no. 1, respectively, and being depicted in the same respective line as said Ylr185w or a functional equivalent or a homologue thereof as depicted in column 7 of table II, application no. 1, preferably a homologue or functional equivalent as depicted in column 7 of table II B, application no. 1, and being depicted in the same respective line as said Ylr185w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "protein component of the large ribosomal subunit", preferably it is the molecule of section (a) or (b) of this paragraph.

In one embodiment, said molecule, which activity is to be increased in the process of the invention and which is the gene product with an activity as described as a "protein component of the large ribosomal subunit", is increased cytoplasmic.

The sequence of Ylr204w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as mitochondrial protein.

Accordingly, in one embodiment, the process of the present invention comprises increasing or generating the activity of a gene product with the activity of a "mitochondrial protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr204w or a functional equivalent or a homologue thereof as shown in column 7 of table I, application no. 1, preferably a homologue or functional equivalent as shown in column 7 of table I B, application no. 1, and being depicted in the same respective line as said Ylr204w; or
(b) a polypeptide comprising a polypeptide, a consensus sequence or a polypeptide motif as shown in column 5 of table II or in column 7 of table IV, application no. 1, respectively, and being depicted in the same respective line as said Ylr204w or a functional equivalent or a homologue thereof as depicted in column 7 of table II, application no. 1, preferably a homologue or functional equivalent as depicted in column 7 of table II B, application no. 1, and being depicted in the same respective line as said Ylr204w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "mitochondrial protein", preferably it is the molecule of section (a) or (b) of this paragraph.

In one embodiment, said molecule, which activity is to be increased in the process of the invention and which is the gene product with an activity as described as a "mitochondrial protein", is increased cytoplasmic.

In one embodiment, said molecule, which activity is to be increased in the process of the invention and which is the gene product with an activity as described as a "mitochondrial protein", is increased plastidic.

The sequence of Ylr242c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ARV1 protein.

Accordingly, in one embodiment, the process of the present invention comprises increasing or generating the activity of a gene product with the activity of a "ARV1 protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr242c or a functional equivalent or a homologue thereof as shown in column 7 of table I, application no. 1, preferably a homologue or functional equivalent as shown in column 7 of table I B, application no. 1, and being depicted in the same respective line as said Ylr242c; or
(b) a polypeptide comprising a polypeptide, a consensus sequence or a polypeptide motif as shown in column 5 of table II or in column 7 of table IV, application no. 1, respectively, and being depicted in the same respective line as said Ylr242c or a functional equivalent or a homologue thereof as depicted in column 7 of table II, application no. 1, preferably a homologue or functional equivalent as depicted in column 7 of table II B, application no. 1, and being depicted in the same respective line as said Ylr242c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ARV1 protein", preferably it is the molecule of section (a) or (b) of this paragraph.

In one embodiment, said molecule, which activity is to be increased in the process of the invention and which is the gene product with an activity as described as a "ARV1 protein", is increased cytoplasmic.

The sequence of Ylr293c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as GTP-binding protein.

Accordingly, in one embodiment, the process of the present invention comprises increasing or generating the activity of a gene product with the activity of a "GTP-binding protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr293c or a functional equivalent or a homologue thereof as shown in column 7 of table I, application no. 1, preferably a homologue or functional equivalent as shown in column 7 of table I B, application no. 1, and being depicted in the same respective line as said Ylr293c; or
(b) a polypeptide comprising a polypeptide, a consensus sequence or a polypeptide motif as shown in column 5 of table II or in column 7 of table IV, application no. 1, respectively, and being depicted in the same respective line as said Ylr293c or a functional equivalent or a homologue thereof as depicted in column 7 of table II, application no. 1, preferably a homologue or functional equivalent as depicted in column 7 of table II B, application no. 1, and being depicted in the same respective line as said Ylr293c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "GTP-binding protein", preferably it is the molecule of section (a) or (b) of this paragraph.

In one embodiment, said molecule, which activity is to be increased in the process of the invention and which is the gene product with an activity as described as a "GTP-binding protein", is increased cytoplasmic.

The sequence of Ylr313c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as protein involved in shmoo formation and bipolar bud site selection.

Accordingly, in one embodiment, the process of the present invention comprises increasing or generating the activity of a gene product with the activity of a "protein involved in shmoo formation and bipolar bud site selection" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr313c or a functional equivalent or a homologue thereof as shown in column 7 of table I, application no. 1, preferably a homologue or functional equivalent as shown in column 7 of table I B, application no. 1, and being depicted in the same respective line as said Ylr313c; or
(b) a polypeptide comprising a polypeptide, a consensus sequence or a polypeptide motif as shown in column 5 of table II or in column 7 of table IV, application no. 1, respectively, and being depicted in the same respective line as said Ylr313c or a functional equivalent or a homologue thereof as depicted in column 7 of table II, application no. 1, preferably a homologue or functional equivalent as depicted in column 7 of table II B, application no. 1, and being depicted in the same respective line as said Ylr313c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "protein involved in shmoo formation and bipolar bud site selection", preferably it is the molecule of section (a) or (b) of this paragraph.

In one embodiment, said molecule, which activity is to be increased in the process of the invention and which is the gene product with an activity as described as a "protein involved in shmoo formation and bipolar bud site selection", is increased cytoplasmic.

The sequence of Ylr315w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as non-essential kinetochore protein.

Accordingly, in one embodiment, the process of the present invention comprises increasing or generating the activity of a gene product with the activity of a "non-essential kinetochore protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr315w or a functional equivalent or a homologue thereof as shown in column 7 of table I, application no. 1, preferably a homologue or functional equivalent as shown in column 7 of table I B, application no. 1, and being depicted in the same respective line as said Ylr315w; or
(b) a polypeptide comprising a polypeptide, a consensus sequence or a polypeptide motif as shown in column 5 of table II or in column 7 of table IV, application no. 1, respectively, and being depicted in the same respective line as said Ylr315w or a functional equivalent or a homologue thereof as depicted in column 7 of table II, application no. 1, preferably a homologue or functional equivalent as depicted in column 7 of table II B, application no. 1, and being depicted in the same respective line as said Ylr315w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "non-essential kinetochore protein", preferably it is the molecule of section (a) or (b) of this paragraph.

In one embodiment, said molecule, which activity is to be increased in the process of the invention and which is the gene product with an activity as described as a "non-essential kinetochore protein", is increased cytoplasmic.

The sequence of Ylr329w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Meiotic recombination protein.

Accordingly, in one embodiment, the process of the present invention comprises increasing or generating the activity of a gene product with the activity of a "Meiotic recombination protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr329w or a functional equivalent or a homologue thereof as shown in column 7 of table I, application no. 1, preferably a homologue or functional equivalent as shown in column 7 of table I B, application no. 1, and being depicted in the same respective line as said Ylr329w; or
(b) a polypeptide comprising a polypeptide, a consensus sequence or a polypeptide motif as shown in column 5 of table II or in column 7 of table IV, application no. 1, respectively, and being depicted in the same respective line as said Ylr329w or a functional equivalent or a homologue thereof as depicted in column 7 of table II, application no. 1, preferably a homologue or functional equivalent as depicted in column 7 of table II B, application no. 1, and being depicted in the same respective line as said Ylr329w,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Meiotic recombination protein", preferably it is the molecule of section (a) or (b) of this paragraph.

In one embodiment, said molecule, which activity is to be increased in the process of the invention and which is the gene product with an activity as described as a "Meiotic recombination protein", is increased cytoplasmic.

The sequence of Ylr362w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as signal transducing MEK kinase.

Accordingly, in one embodiment, the process of the present invention comprises increasing or generating the activity of a gene product with the activity of a "signal transducing MEK kinase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr362w or a functional equivalent or a homologue thereof as shown in column 7 of table I, application no. 1, preferably a homologue or functional equivalent as shown in column 7 of table I B, application no. 1, and being depicted in the same respective line as said Ylr362w; or
(b) a polypeptide comprising a polypeptide, a consensus sequence or a polypeptide motif as shown in column 5 of table II or in column 7 of table IV, application no. 1, respectively, and being depicted in the same respective line as said Ylr362w or a functional equivalent or a homologue thereof as depicted in column 7 of table II, application no. 1, preferably a homologue or functional equivalent as depicted in column 7 of table II B, application no. 1, and being depicted in the same respective line as said Ylr362w,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "signal transducing MEK kinase", preferably it is the molecule of section (a) or (b) of this paragraph.

In one embodiment, said molecule, which activity is to be increased in the process of the invention and which is the gene product with an activity as described as a "signal transducing MEK kinase", is increased cytoplasmic.

The sequence of Ylr395c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as cytochrome c oxidase subunit VIII.

Accordingly, in one embodiment, the process of the present invention comprises increasing or generating the activity of a gene product with the activity of a "cytochrome c oxidase subunit VIII" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr395c or a functional equivalent or a homologue thereof as shown in column 7 of table I, application no. 1, preferably a homologue or functional equivalent as shown in column 7 of table I B, application no. 1, and being depicted in the same respective line as said Ylr395c; or
(b) a polypeptide comprising a polypeptide, a consensus sequence or a polypeptide motif as shown in column 5 of table II or in column 7 of table IV, application no. 1, respectively, and being depicted in the same respective line as said Ylr395c or a functional equivalent or a homologue thereof as depicted in column 7 of table II, application no. 1, preferably a homologue or functional equivalent as depicted in column 7 of table II B, application no. 1, and being depicted in the same respective line as said Ylr395c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "cytochrome c oxidase subunit VIII", preferably it is the molecule of section (a) or (b) of this paragraph.

In one embodiment, said molecule, which activity is to be increased in the process of the invention and which is the gene product with an activity as described as a "cytochrome c oxidase subunit VIII", is increased cytoplasmic.

The sequence of Ylr404w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ylr404w-protein.

Accordingly, in one embodiment, the process of the present invention comprises increasing or generating the activity of a gene product with the activity of a "ylr404w-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ylr404w or a functional equivalent or a homologue thereof as shown in column 7 of table I, application no. 1, preferably a homologue or functional equivalent as shown in column 7 of table I B, application no. 1, and being depicted in the same respective line as said Ylr404w; or (b) a polypeptide comprising a polypeptide, a consensus sequence or a polypeptide motif as shown in column 5 of table II or in column 7 of table IV, application no. 1, respectively, and being depicted in the same respective line as said Ylr404w or a functional equivalent or a homologue thereof as depicted in column 7 of table II, application no. 1, preferably a homologue or functional equivalent as depicted in column 7 of table II B, application no. 1, and being depicted in the same respective line as said Ylr404w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ylr404w-protein", preferably it is the molecule of section (a) or (b) of this paragraph.

In one embodiment, said molecule, which activity is to be increased in the process of the invention and which is the gene product with an activity as described as a "ylr404w-protein", is increased cytoplasmic.

The sequence of Ylr463c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ylr463c-protein.

Accordingly, in one embodiment, the process of the present invention comprises increasing or generating the activity of a gene product with the activity of a "ylr463c-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ylr463c or a functional equivalent or a homologue thereof as shown in column 7 of table I, application no. 1, preferably a homologue or functional equivalent as shown in column 7 of table I B, application no. 1, and being depicted in the same respective line as said Ylr463c; or (b) a polypeptide comprising a polypeptide, a consensus sequence or a polypeptide motif as shown in column 5 of table II or in column 7 of table IV, application no. 1, respectively, and being depicted in the same respective line as said Ylr463c or a functional equivalent or a homologue thereof as depicted in column 7 of table II, application no. 1, preferably a homologue or functional equivalent as depicted in column 7 of table II B, application no. 1, and being depicted in the same respective line as said Ylr463c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ylr463c-protein", preferably it is the molecule of section (a) or (b) of this paragraph.

In one embodiment, said molecule, which activity is to be increased in the process of the invention and which is the gene product with an activity as described as a "ylr463c-protein", is increased cytoplasmic.

The sequence of Yml022w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as adenine phosphoribosyltransferase.

Accordingly, in one embodiment, the process of the present invention comprises increasing or generating the activity of a gene product with the activity of a "adenine phosphoribosyltransferase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yml022w or a functional equivalent or a homologue thereof as shown in column 7 of table I, application no. 1, preferably a homologue or functional equivalent as shown in column 7 of table I B, application no. 1, and being depicted in the same respective line as said Yml022w; or (b) a polypeptide comprising a polypeptide, a consensus sequence or a polypeptide motif as shown in column 5 of table II or in column 7 of table IV, application no. 1, respectively, and being depicted in the same respective line as said Yml022w or a functional equivalent or a homologue thereof as depicted in column 7 of table II, application no. 1, preferably a homologue or functional equivalent as depicted in column 7 of table II B, application no. 1, and being depicted in the same respective line as said Yml022w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "adenine phosphoribosyltransferase", preferably it is the molecule of section (a) or (b) of this paragraph.

In one embodiment, said molecule, which activity is to be increased in the process of the invention and which is the gene product with an activity as described as a "adenine phosphoribosyltransferase", is increased cytoplasmic.

The sequence of Yml027w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Mcm1p binding transcriptional repressor.

Accordingly, in one embodiment, the process of the present invention comprises increasing or generating the activity of a gene product with the activity of a "Mcm1p binding transcriptional repressor" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yml027w or a functional equivalent or a homologue thereof as shown in column 7 of table I, application no. 1, preferably a homologue or functional equivalent as shown in column 7 of table I B, application no. 1, and being depicted in the same respective line as said Yml027w; or (b) a polypeptide comprising a polypeptide, a consensus sequence or a polypeptide motif as shown in column 5 of table II or in column 7 of table IV, application no. 1, respectively, and being depicted in the same respective line as said Yml027w or a functional equivalent or a homologue thereof as depicted in column 7 of table II, application no. 1, preferably a homologue or functional equivalent as depicted in column 7 of table II B, application no. 1, and being depicted in the same respective line as said Yml027w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Mcm1p binding transcriptional repressor", preferably it is the molecule of section (a) or (b) of this paragraph.

In one embodiment, said molecule, which activity is to be increased in the process of the invention and which is the gene product with an activity as described as a "Mcm1p binding transcriptional repressor", is increased cytoplasmic.

The sequence of Yml065w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as origin recognition complex subunit.

Accordingly, in one embodiment, the process of the present invention comprises increasing or generating the activity of a gene product with the activity of a "origin recognition complex subunit" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yml065w or a functional equivalent or a homologue thereof as shown in column 7 of table I, application no. 1, preferably a homologue or functional equivalent as shown in column 7 of table I B, application no. 1, and being depicted in the same respective line as said Yml065w; or (b) a polypeptide comprising a polypeptide, a consensus sequence or a polypeptide motif as shown in column 5 of table II or in column 7 of table IV, application no. 1, respectively, and being depicted in the same respective line as said Yml065w or a functional equivalent or a homologue thereof as depicted in column 7 of table II, application no. 1, preferably a homologue or functional equivalent as depicted in column 7 of table II B, application no. 1, and being depicted in the same respective line as said Yml065w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "origin recognition complex subunit", preferably it is the molecule of section (a) or (b) of this paragraph.

In one embodiment, said molecule, which activity is to be increased in the process of the invention and which is the gene product with an activity as described as a "origin recognition complex subunit", is increased cytoplasmic.

The sequence of Yml089c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yml089c-protein.

Accordingly, in one embodiment, the process of the present invention comprises increasing or generating the activity of a gene product with the activity of a "yml089c-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yml089c or a functional equivalent or a homologue thereof as shown in column 7 of table I, application no. 1, preferably a homologue or functional equivalent as shown in column 7 of table I B, application no. 1, and being depicted in the same respective line as said Yml089c; or (b) a polypeptide comprising a polypeptide, a consensus sequence or a polypeptide motif as shown in column 5 of table II or in column 7 of table IV, application no. 1, respectively, and being depicted in the same respective line as said Yml089c or a functional equivalent or a homologue thereof as depicted in column 7 of table II, application no. 1, preferably a homologue or functional equivalent as depicted in column 7 of table II B, application no. 1, and being depicted in the same respective line as said Yml089c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yml089c-protein", preferably it is the molecule of section (a) or (b) of this paragraph.

In one embodiment, said molecule, which activity is to be increased in the process of the invention and which is the gene product with an activity as described as a "yml089c-protein", is increased cytoplasmic.

The sequence of Yml128c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as yml128c-protein.

Accordingly, in one embodiment, the process of the present invention comprises increasing or generating the activity of a gene product with the activity of a "yml128c-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Yml128c or a functional equivalent or a homologue thereof as shown in column 7 of table I, application no. 1, preferably a homologue or functional equivalent as shown in column 7 of table I B, application no. 1, and being depicted in the same respective line as said Yml128c; or
(b) a polypeptide comprising a polypeptide, a consensus sequence or a polypeptide motif as shown in column 5 of table II or in column 7 of table IV, application no. 1, respectively, and being depicted in the same respective line as said Yml128c or a functional equivalent or a homologue thereof as depicted in column 7 of table II, application no. 1, preferably a homologue or functional equivalent as depicted in column 7 of table II B, application no. 1, and being depicted in the same respective line as said Yml128c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "yml128c-protein", preferably it is the molecule of section (a) or (b) of this paragraph.

In one embodiment, said molecule, which activity is to be increased in the process of the invention and which is the gene product with an activity as described as a "yml128c-protein", is increased cytoplasmic.

The sequence of Ymr011w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as hexose transporter.

Accordingly, in one embodiment, the process of the present invention comprises increasing or generating the activity of a gene product with the activity of a "hexose transporter" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ymr011w or a functional equivalent or a homologue thereof as shown in column 7 of table I, application no. 1, preferably a homologue or functional equivalent as shown in column 7 of table I B, application no. 1, and being depicted in the same respective line as said Ymr011w; or
(b) a polypeptide comprising a polypeptide, a consensus sequence or a polypeptide motif as shown in column 5 of table II or in column 7 of table IV, application no. 1, respectively, and being depicted in the same respective line as said Ymr011w or a functional equivalent or a homologue thereof as depicted in column 7 of table II, application no. 1, preferably a homologue or functional equivalent as depicted in column 7 of table II B, application no. 1, and being depicted in the same respective line as said Ymr011w,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "hexose transporter", preferably it is the molecule of section (a) or (b) of this paragraph.

In one embodiment, said molecule, which activity is to be increased in the process of the invention and which is the gene product with an activity as described as a "hexose transporter", is increased cytoplasmic.

The sequence of Ymr037c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Zinc finger protein.

Accordingly, in one embodiment, the process of the present invention comprises increasing or generating the activity of a gene product with the activity of a "Zinc finger protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ymr037c or a functional equivalent or a homologue thereof as shown in column 7 of table I, application no. 1, preferably a homologue or functional equivalent as shown in column 7 of table I B, application no. 1, and being depicted in the same respective line as said Ymr037c; or
(b) a polypeptide comprising a polypeptide, a consensus sequence or a polypeptide motif as shown in column 5 of table II or in column 7 of table IV, application no. 1, respectively, and being depicted in the same respective line as said Ymr037c or a functional equivalent or a homologue thereof as depicted in column 7 of table II, application no. 1, preferably a homologue or functional equivalent as depicted in column 7 of table II B, application no. 1, and being depicted in the same respective line as said Ymr037c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Zinc finger protein", preferably it is the molecule of section (a) or (b) of this paragraph.

In one embodiment, said molecule, which activity is to be increased in the process of the invention and which is the gene product with an activity as described as a "Zinc finger protein", is increased cytoplasmic.

The sequence of Ymr049c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as protein required for maturation of ribosomal RNAs.

Accordingly, in one embodiment, the process of the present invention comprises increasing or generating the activity of a gene product with the activity of a "protein required for maturation of ribosomal RNAs" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ymr049c or a functional equivalent or a homologue thereof as shown in column 7 of table I, application no. 1, preferably a homologue or functional equivalent as shown in column 7 of table I B, application no. 1, and being depicted in the same respective line as said Ymr049c; or (b) a polypeptide comprising a polypeptide, a consensus sequence or a polypeptide motif as shown in column 5 of table II or in column 7 of table IV, application no. 1, respectively, and being depicted in the same respective line as said Ymr049c or a functional equivalent or a homologue thereof as depicted in column 7 of table II, application no. 1, preferably a homologue or functional equivalent as depicted in column 7 of table II B, application no. 1, and being depicted in the same respective line as said Ymr049c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "protein required for maturation of ribosomal RNAs", preferably it is the molecule of section (a) or (b) of this paragraph.

In one embodiment, said molecule, which activity is to be increased in the process of the invention and which is the gene product with an activity as described as a "protein required for maturation of ribosomal RNAs", is increased cytoplasmic.

The sequence of Ymr052w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Factor arrest protein.

Accordingly, in one embodiment, the process of the present invention comprises increasing or generating the activity of a gene product with the activity of a "Factor arrest protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ymr052w or a functional equivalent or a homologue thereof as shown in column 7 of table I, application no. 1, preferably a homologue or functional equivalent as shown in column 7 of table I B, application no. 1, and being depicted in the same respective line as said Ymr052w; or (b) a polypeptide comprising a polypeptide, a consensus sequence or a polypeptide motif as shown in column 5 of table II or in column 7 of table IV, application no. 1, respectively, and being depicted in the same respective line as said Ymr052w or a functional equivalent or a homologue thereof as depicted in column 7 of table II, application no. 1, preferably a homologue or functional equivalent as depicted in column 7 of table II B, application no. 1, and being depicted in the same respective line as said Ymr052w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Factor arrest protein", preferably it is the molecule of section (a) or (b) of this paragraph.

In one embodiment, said molecule, which activity is to be increased in the process of the invention and which is the gene product with an activity as described as a "Factor arrest protein", is increased cytoplasmic.

The sequence of Ymr082c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YMR082C-protein.

Accordingly, in one embodiment, the process of the present invention comprises increasing or generating the activity of a gene product with the activity of a "YMR082C-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ymr082c or a functional equivalent or a homologue thereof as shown in column 7 of table I, application no. 1, preferably a homologue or functional equivalent as shown in column 7 of table I B, application no. 1, and being depicted in the same respective line as said Ymr082c; or (b) a polypeptide comprising a polypeptide, a consensus sequence or a polypeptide motif as shown in column 5 of table II or in column 7 of table IV, application no. 1, respectively, and being depicted in the same respective line as said Ymr082c or a functional equivalent or a homologue thereof as depicted in column 7 of table II, application no. 1, preferably a homologue or functional equivalent as depicted in column 7 of table II B, application no. 1, and being depicted in the same respective line as said Ymr082c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YMR082C-protein", preferably it is the molecule of section (a) or (b) of this paragraph.

In one embodiment, said molecule, which activity is to be increased in the process of the invention and which is the gene product with an activity as described as a "YMR082C-protein", is increased cytoplasmic.

The sequence of YMR125W from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Nuclear cap-binding protein complex subunit.

Accordingly, in one embodiment, the process of the present invention comprises increasing or generating the activity of a gene product with the activity of a "Nuclear cap-binding protein complex subunit" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said YMR125W or a functional equivalent or a homologue thereof as shown in column 7 of table I, application no. 1, preferably a homologue or functional equivalent as shown in column 7 of table I B, application no. 1, and being depicted in the same respective line as said YMR125W; or (b) a polypeptide comprising a polypeptide, a consensus sequence or a polypeptide motif as shown in column 5 of table II or in column 7 of table IV, application no. 1, respectively, and being depicted in the same respective line as said YMR125W or a functional equivalent or a homologue thereof as depicted in column 7 of table II, application no. 1, preferably a homologue or functional equivalent as depicted in column 7 of table II B, application no. 1, and being depicted in the same respective line as said YMR125W, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Nuclear cap-binding protein complex subunit", preferably it is the molecule of section (a) or (b) of this paragraph.

In one embodiment, said molecule, which activity is to be increased in the process of the invention and which is the gene product with an activity as described as a "Nuclear cap-binding protein complex subunit", is increased cytoplasmic.

The sequence of Ymr126c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YMR126C membrane protein.

Accordingly, in one embodiment, the process of the present invention comprises increasing or generating the activity of a gene product with the activity of a "YMR126c membrane protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ymr126c or a functional equivalent or a homologue thereof as shown in column 7 of table I, application no. 1, preferably a homologue or functional equivalent as shown in column 7 of table I B, application no. 1, and being depicted in the same respective line as said Ymr126c; or (b) a polypeptide comprising a polypeptide, a consensus sequence or a polypeptide motif as shown in column 5 of table II or in column 7 of table IV, application no. 1, respectively, and being depicted in the same respective line as said Ymr126c or a functional equivalent or a homologue thereof as depicted in column 7 of table II, application no. 1, preferably a homologue or functional equivalent as depicted in column 7 of table II B, application no. 1, and being depicted in the same respective line as said Ymr126c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YMR126C membrane protein", preferably it is the molecule of section (a) or (b) of this paragraph.

In one embodiment, said molecule, which activity is to be increased in the process of the invention and which is the gene product with an activity as described as a "YMR126C membrane protein", is increased cytoplasmic.

The sequence of Ymr144w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YMR144W-protein.

Accordingly, in one embodiment, the process of the present invention comprises increasing or generating the activity of a gene product with the activity of a "YMR144W-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ymr144w or a functional equivalent or a homologue thereof as shown in column 7 of table I, application no. 1, preferably a homologue or functional equivalent as shown in column 7 of table I B, application no. 1, and being depicted in the same respective line as said Ymr144w; or (b) a polypeptide comprising a polypeptide, a consensus sequence or a polypeptide motif as shown in column 5 of table II or in column 7 of table IV, application no. 1, respectively, and being depicted in the same respective line as said Ymr144w or a functional equivalent or a homologue thereof as depicted in column 7 of table II, application no. 1, preferably a homologue or functional equivalent as depicted in column 7 of table II B, application no. 1, and being depicted in the same respective line as said Ymr144w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YMR144W-protein", preferably it is the molecule of section (a) or (b) of this paragraph.

In one embodiment, said molecule, which activity is to be increased in the process of the invention and which is the gene product with an activity as described as a "YMR144W-protein", is increased cytoplasmic.

The sequence of Ymr160w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YMR160W-protein.

Accordingly, in one embodiment, the process of the present invention comprises increasing or generating the activity of a gene product with the activity of a "YMR160W-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ymr160w or a functional equivalent or a homologue thereof as shown in column 7 of table I, application no. 1, preferably a homologue or functional equivalent as shown in column 7 of table I B, application no. 1, and being depicted in the same respective line as said Ymr160w; or (b) a polypeptide comprising a polypeptide, a consensus sequence or a polypeptide motif as shown in column 5 of table II or in column 7 of table IV, application no. 1, and being depicted in the same respective line as said Ymr160w or a functional equivalent or a homologue thereof as depicted in column 7 of table II, application no. 1, preferably a homologue or functional equivalent as depicted in column 7 of table II B, application no. 1, and being depicted in the same respective line as said Ymr160w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YMR160W-protein", preferably it is the molecule of section (a) or (b) of this paragraph.

In one embodiment, said molecule, which activity is to be increased in the process of the invention and which is the gene product with an activity as described as a "YMR160W-protein", is increased cytoplasmic.

The sequence of Ymr191w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Stationary phase protein.

Accordingly, in one embodiment, the process of the present invention comprises increasing or generating the activity of a gene product with the activity of a "Stationary phase protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ymr191w or a functional equivalent or a homologue thereof as shown in column 7 of table I, application no. 1, preferably a homologue or functional equivalent as shown in column 7 of table I B, application no. 1, and being depicted in the same respective line as said Ymr191w; or (b) a polypeptide comprising a polypeptide, a consensus sequence or a polypeptide motif as shown in column 5 of table II or in column 7 of table IV, application no. 1, respectively, and being depicted in the same respective line as said Ymr191w or a functional equivalent or a homologue thereof as depicted in column 7 of table II, application no. 1, preferably a homologue or functional equivalent as depicted in column 7 of table II B, application no. 1, and being depicted in the same respective line as said Ymr191w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Stationary phase protein", preferably it is the molecule of section (a) or (b) of this paragraph.

In one embodiment, said molecule, which activity is to be increased in the process of the invention and which is the gene product with an activity as described as a "Stationary phase protein", is increased cytoplasmic.

The sequence of Ymr209c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YMR209C-protein.

Accordingly, in one embodiment, the process of the present invention comprises increasing or generating the activity of a gene product with the activity of a "YMR209C-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ymr209c or a functional equivalent or a homologue thereof as shown in column 7 of table I, application no. 1, preferably a homologue or functional equivalent as shown in column 7 of table I B, application no. 1, and being depicted in the same respective line as said Ymr209c; or
(b) a polypeptide comprising a polypeptide, a consensus sequence or a polypeptide motif as shown in column 5 of table II or in column 7 of table IV, application no. 1, respectively, and being depicted in the same respective line as said Ymr209c or a functional equivalent or a homologue thereof as depicted in column 7 of table II, application no. 1, preferably a homologue or functional equivalent as depicted in column 7 of table II B, application no. 1, and being depicted in the same respective line as said Ymr209c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YMR209C-protein", preferably it is the molecule of section (a) or (b) of this paragraph.

In one embodiment, said molecule, which activity is to be increased in the process of the invention and which is the gene product with an activity as described as a "YMR209C-protein", is increased cytoplasmic.

The sequence of Ymr233w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YMR233W-protein.

Accordingly, in one embodiment, the process of the present invention comprises increasing or generating the activity of a gene product with the activity of a "YMR233W-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ymr233w or a functional equivalent or a homologue thereof as shown in column 7 of table I, application no. 1, preferably a homologue or functional equivalent as shown in column 7 of table I B, application no. 1, and being depicted in the same respective line as said Ymr233w; or
(b) a polypeptide comprising a polypeptide, a consensus sequence or a polypeptide motif as shown in column 5 of table II or in column 7 of table IV, application no. 1, respectively, and being depicted in the same respective line as said Ymr233w or a functional equivalent or a homologue thereof as depicted in column 7 of table II, application no. 1, preferably a homologue or functional equivalent as depicted in column 7 of table II B, application no. 1, and being depicted in the same respective line as said Ymr233w,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YMR233W-protein", preferably it is the molecule of section (a) or (b) of this paragraph.

In one embodiment, said molecule, which activity is to be increased in the process of the invention and which is the gene product with an activity as described as a "YMR233W-protein", is increased cytoplasmic.

The sequence of Ymr278w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as phosphoglucomutase/phosphomannomutase.

Accordingly, in one embodiment, the process of the present invention comprises increasing or generating the activity of a gene product with the activity of a "phosphoglucomutase/phosphomannomutase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ymr278w or a functional equivalent or a homologue thereof as shown in column 7 of table I, application no. 1, preferably a homologue or functional equivalent as shown in column 7 of table I B, application no. 1, and being depicted in the same respective line as said Ymr278w; or
(b) a polypeptide comprising a polypeptide, a consensus sequence or a polypeptide motif as shown in column 5 of table II or in column 7 of table IV, application no. 1, respectively, and being depicted in the same respective line as said Ymr278w or a functional equivalent or a homologue thereof as depicted in column 7 of table II, application no. 1, preferably a homologue or functional equivalent as depicted in column 7 of table II B, application no. 1, and being depicted in the same respective line as said Ymr278w,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "phosphoglucomutase/phosphomannomutase", preferably it is the molecule of section (a) or (b) of this paragraph.

In one embodiment, said molecule, which activity is to be increased in the process of the invention and which is the gene product with an activity as described as a "phosphoglucomutase/phosphomannomutase", is increased cytoplasmic.

The sequence of Ymr280c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Regulatory CAT8 protein.

Accordingly, in one embodiment, the process of the present invention comprises increasing or generating the activity of a gene product with the activity of a "Regulatory CAT8 protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ymr280c or a functional equivalent or a homologue thereof as shown in column 7 of table I, application no. 1, preferably a homologue or functional equivalent as shown in column 7 of table I B, application no. 1, and being depicted in the same respective line as said Ymr280c; or (b) a polypeptide comprising a polypeptide, a consensus sequence or a polypeptide motif as shown in column 5 of table II or in column 7 of table IV, application no. 1, respectively, and being depicted in the same respective line as said Ymr280c or a functional equivalent or a homologue thereof as depicted in column 7 of table II, application no. 1, preferably a homologue or functional equivalent as depicted in column 7 of table II B, application no. 1, and being depicted in the same respective line as said Ymr280c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Regulatory CAT8 protein", preferably it is the molecule of section (a) or (b) of this paragraph.

In one embodiment, said molecule, which activity is to be increased in the process of the invention and which is the gene product with an activity as described as a "Regulatory CAT8 protein", is increased cytoplasmic.

The sequence of Ynl014w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as translational elongation factor EF-3 (HEF3).

Accordingly, in one embodiment, the process of the present invention comprises increasing or generating the activity of a gene product with the activity of a "translational elongation factor EF-3 (HEF3)" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ynl014w or a functional equivalent or a homologue thereof as shown in column 7 of table I, application no. 1, preferably a homologue or functional equivalent as shown in column 7 of table I B, application no. 1, and being depicted in the same respective line as said Ynl014w; or (b) a polypeptide comprising a polypeptide, a consensus sequence or a polypeptide motif as shown in column 5 of table II or in column 7 of table IV, application no. 1, respectively, and being depicted in the same respective line as said Ynl014w or a functional equivalent or a homologue thereof as depicted in column 7 of table II, application no. 1, preferably a homologue or functional equivalent as depicted in column 7 of table II B, application no. 1, and being depicted in the same respective line as said Ynl014w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "translational elongation factor EF-3 (HEF3)", preferably it is the molecule of section (a) or (b) of this paragraph.

In one embodiment, said molecule, which activity is to be increased in the process of the invention and which is the gene product with an activity as described as a "translational elongation factor EF-3 (HEF3)", is increased cytoplasmic.

The sequence of Ynl320w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YNL320W-protein.

Accordingly, in one embodiment, the process of the present invention comprises increasing or generating the activity of a gene product with the activity of a "YNL320W-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ynl320w or a functional equivalent or a homologue thereof as shown in column 7 of table I, application no. 1, preferably a homologue or functional equivalent as shown in column 7 of table I B, application no. 1, and being depicted in the same respective line as said Ynl320w; or (b) a polypeptide comprising a polypeptide, a consensus sequence or a polypeptide motif as shown in column 5 of table II or in column 7 of table IV, application no. 1, respectively, and being depicted in the same respective line as said Ynl320w or a functional equivalent or a homologue thereof as depicted in column 7 of table II, application no. 1, preferably a homologue or functional equivalent as depicted in column 7 of table II B, application no. 1, and being depicted in the same respective line as said Ynl320w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YNL320W-protein", preferably it is the molecule of section (a) or (b) of this paragraph.

In one embodiment, said molecule, which activity is to be increased in the process of the invention and which is the gene product with an activity as described as a "YNL320W-protein", is increased cytoplasmic.

The sequence of Yol007c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Chitin synthase 3 complex protein.

Accordingly, in one embodiment, the process of the present invention comprises increasing or generating the activity of a gene product with the activity of a "Chitin synthase 3 complex protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yol007c or a functional equivalent or a homologue thereof as shown in column 7 of table I, application no. 1, preferably a homologue or functional equivalent as shown in column 7 of table I B, application no. 1, and being depicted in the same respective line as said Yol007c; or (b) a polypeptide comprising a polypeptide, a consensus sequence or a polypeptide motif as shown in column 5 of table II or in column 7 of table IV, application no. 1, respectively, and being depicted in the same respective line as said Yol007c or a functional equivalent or a homologue thereof as depicted in column 7 of table II, application no. 1, preferably a homologue or functional equivalent as depicted in column 7 of table II B, application no. 1, and being depicted in the same respective line as said Yol007c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Chitin synthase 3 complex protein", preferably it is the molecule of section (a) or (b) of this paragraph.

In one embodiment, said molecule, which activity is to be increased in the process of the invention and which is the gene product with an activity as described as a "Chitin synthase 3 complex protein", is increased cytoplasmic.

The sequence of Yol164w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Alkyl/aryl-sulfatase.

Accordingly, in one embodiment, the process of the present invention comprises increasing or generating the activity of a gene product with the activity of a "Alkyl/aryl-sulfatase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yol164w or a functional equivalent or a homologue thereof as shown in column 7 of table I, application no. 1, preferably a homologue or functional equivalent as shown in column 7 of table I B, application no. 1, and being depicted in the same respective line as said Yol164w; or (b) a polypeptide comprising a polypeptide, a consensus sequence or a polypeptide motif as shown in column 5 of table II or in column 7 of table IV, application no. 1, respectively, and being depicted in the same respective line as said Yol164w or a functional equivalent or a homologue thereof as depicted in column 7 of table II, application no. 1, preferably a homologue or functional equivalent as depicted in column 7 of table II B, application no. 1, and being depicted in the same respective line as said Yol164w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Alkyl/aryl-sulfatase", preferably it is the molecule of section (a) or (b) of this paragraph.

In one embodiment, said molecule, which activity is to be increased in the process of the invention and which is the gene product with an activity as described as a "Alkyl/aryl-sulfatase", is increased cytoplasmic.

The sequence of Yor076c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as antiviral adaptor protein.

Accordingly, in one embodiment, the process of the present invention comprises increasing or generating the activity of a gene product with the activity of a "antiviral adaptor protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yor076c or a functional equivalent or a homologue thereof as shown in column 7 of table I, application no. 1, preferably a homologue or functional equivalent as shown in column 7 of table I B, application no. 1, and being depicted in the same respective line as said Yor076c; or (b) a polypeptide comprising a polypeptide, a consensus sequence or a polypeptide motif as shown in column 5 of table II or in column 7 of table IV, application no. 1, respectively, and being depicted in the same respective line as said Yor076c or a functional equivalent or a homologue thereof as depicted in column 7 of table II, application no. 1, preferably a homologue or functional equivalent as depicted in column 7 of table II B, application no. 1, and being depicted in the same respective line as said Yor076c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "antiviral adaptor protein", preferably it is the molecule of section (a) or (b) of this paragraph.

In one embodiment, said molecule, which activity is to be increased in the process of the invention and which is the gene product with an activity as described as a "antiviral adaptor protein", is increased cytoplasmic.

The sequence of Yor083w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as repressor of G1 transcription.

Accordingly, in one embodiment, the process of the present invention comprises increasing or generating the activity of a gene product with the activity of a "repressor of G1 transcription" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yor083w or a functional equivalent or a homologue thereof as shown in column 7 of table I, application no. 1, preferably a homologue or functional equivalent as shown in column 7 of table I B, application no. 1, and being depicted in the same respective line as said Yor083w; or (b) a polypeptide comprising a polypeptide, a consensus sequence or a polypeptide motif as shown in column 5 of table II or in column 7 of table IV, application no. 1, respectively, and being depicted in the same respective line as said Yor083w or a functional equivalent or a homologue thereof as depicted in column 7 of table II, application no. 1, preferably a homologue or functional equivalent as depicted in column 7 of table II B, application no. 1, and being depicted in the same respective line as said Yor083w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "repressor of G1 transcription", preferably it is the molecule of section (a) or (b) of this paragraph.

In one embodiment, said molecule, which activity is to be increased in the process of the invention and which is the gene product with an activity as described as a "repressor of G1 transcription", is increased cytoplasmic.

The sequence of Yor097c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YOR097C-protein.

Accordingly, in one embodiment, the process of the present invention comprises increasing or generating the activity of a gene product with the activity of a "YOR097C-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yor097c or a functional equivalent or a homologue thereof as shown in column 7 of table I, application no. 1, preferably a homologue or functional equivalent as shown in column 7 of table I B, application no. 1, and being depicted in the same respective line as said Yor097c; or (b) a polypeptide comprising a polypeptide, a consensus sequence or a polypeptide motif as shown in column 5 of table II or in column 7 of table IV, application no. 1, respectively, and being depicted in the same respective line as said Yor097c or a functional equivalent or a homologue thereof as depicted in column 7 of table II, application no. 1, preferably a homologue or functional equivalent as depicted in column 7 of table II B, application no. 1, and being depicted in the same respective line as said Yor097c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YOR097C-protein", preferably it is the molecule of section (a) or (b) of this paragraph.

In one embodiment, said molecule, which activity is to be increased in the process of the invention and which is the gene product with an activity as described as a "YOR097C-protein", is increased cytoplasmic.

The sequence of Yor128c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Phosphoribosylaminoimidazole carboxylase.

Accordingly, in one embodiment, the process of the present invention comprises increasing or generating the activity of a gene product with the activity of a "Phosphoribosylaminoimidazole carboxylase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yor128c or a functional equivalent or a homologue thereof as shown in column 7 of table I, application no. 1, preferably a homologue or functional equivalent as shown in column 7 of table I B, application no. 1, and being depicted in the same respective line as said Yor128c; or (b) a polypeptide comprising a polypeptide, a consensus sequence or a polypeptide motif as shown in column 5 of table II or in column 7 of table IV, application no. 1, respectively, and being depicted in the same respective line as said Yor128c or a functional equivalent or a homologue thereof as depicted in column 7 of table II, application no. 1, preferably a homologue or functional equivalent as depicted in column 7 of table II B, application no. 1, and being depicted in the same respective line as said Yor128c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Phosphoribosylaminoimidazole carboxylase", preferably it is the molecule of section (a) or (b) of this paragraph.

In one embodiment, said molecule, which activity is to be increased in the process of the invention and which is the gene product with an activity as described as a "Phosphoribosylaminoimidazole carboxylase", is increased cytoplasmic.

The sequence of Yor353c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as component of the RAM signaling network.

Accordingly, in one embodiment, the process of the present invention comprises increasing or generating the activity of a gene product with the activity of a "component of the RAM signaling network" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yor353c or a functional equivalent or a homologue thereof as shown in column 7 of table I, application no. 1, preferably a homologue or functional equivalent as shown in column 7 of table I B, application no. 1, and being depicted in the same respective line as said Yor353c; or (b) a polypeptide comprising a polypeptide, a consensus sequence or a polypeptide motif as shown in column 5 of table II or in column 7 of table IV, application no. 1, respectively, and being depicted in the same respective line as said Yor353c or a functional equivalent or a homologue thereof as depicted in column 7 of table II, application no. 1, preferably a homologue or functional equivalent as depicted in column 7 of table II B, application no. 1, and being depicted in the same respective line as said Yor353c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "component of the RAM signaling network", preferably it is the molecule of section (a) or (b) of this paragraph.

In one embodiment, said molecule, which activity is to be increased in the process of the invention and which is the gene product with an activity as described as a "component of the RAM signaling network", is increased cytoplasmic.

The sequence of Ypl141c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as protein kinase.

Accordingly, in one embodiment, the process of the present invention comprises increasing or generating the activity of a gene product with the activity of a "protein kinase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ypl141c or a functional equivalent or a homologue thereof as shown in column 7 of table I, application no. 1, preferably a homologue or functional equivalent as shown in column 7 of table I B, application no. 1, and being depicted in the same respective line as said Ypl141c; or (b) a polypeptide comprising a polypeptide, a consensus sequence or a polypeptide motif as shown in column 5 of table II or in column 7 of table IV, application no. 1, respectively, and being depicted in the same respective line as said Ypl141c or a functional equivalent or a homologue thereof as depicted in column 7 of table II, application no. 1, preferably a homologue or functional equivalent as depicted in column 7 of table II B, application no. 1, and being depicted in the same respective line as said Ypl141c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "protein kinase", preferably it is the molecule of section (a) or (b) of this paragraph.

In one embodiment, said molecule, which activity is to be increased in the process of the invention and which is the gene product with an activity as described as a "protein kinase", is increased cytoplasmic.

The sequence of Ypr088c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as signal recognition particle subunit (SRP54).

Accordingly, in one embodiment, the process of the present invention comprises increasing or generating the activity of a gene product with the activity of a "signal recognition particle subunit (SRP54)" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ypr088c or a functional equivalent or a homologue thereof as shown in column 7 of table I, application no. 1, preferably a homologue or functional equivalent as shown in column 7 of table I B, application no. 1, and being depicted in the same respective line as said Ypr088c; or (b) a polypeptide comprising a polypeptide, a consensus sequence or a polypeptide motif as shown in column 5 of table II or in column 7 of table IV, application no. 1, and being depicted in the same respective line as said Ypr088c or a functional equivalent or a homologue thereof as depicted in column 7 of table II, application no. 1, preferably a homologue or functional equivalent as depicted in column 7 of table II B, application no. 1, and being depicted in the same respective line as said Ypr088c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "signal recognition particle subunit (SRP54)", preferably it is the molecule of section (a) or (b) of this paragraph.

In one embodiment, said molecule, which activity is to be increased in the process of the invention and which is the gene product with an activity as described as a "signal recognition particle subunit (SRP54)", is increased cytoplasmic.

The sequence of Ypr108w from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as regulatory subunit of the 26S proteasome.

Accordingly, in one embodiment, the process of the present invention comprises increasing or generating the activity of a gene product with the activity of a "regulatory subunit of the 26S proteasome" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ypr108w or a functional equivalent or a homologue thereof as shown in column 7 of table I, application no. 1, preferably a homologue or functional equivalent as shown in column 7 of table I B, application no. 1, and being depicted in the same respective line as said Ypr108w; or (b) a polypeptide comprising a polypeptide, a consensus sequence or a polypeptide motif as shown in column 5 of table II or in column 7 of table IV, application no. 1, respectively, and being depicted in the same respective line as said Ypr108w or a functional equivalent or a homologue thereof as depicted in column 7 of table II, application no. 1, preferably a homologue or functional equivalent as depicted in column 7 of table II B, application no. 1, and being depicted in the same respective line as said Ypr108w, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "regulatory subunit of the 26S proteasome", preferably it is the molecule of section (a) or (b) of this paragraph.

In one embodiment, said molecule, which activity is to be increased in the process of the invention and which is the gene product with an activity as described as a "regulatory subunit of the 26S proteasome", is increased cytoplasmic.

The sequence of Ypr110c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as RNA polymerase III subunit.

Accordingly, in one embodiment, the process of the present invention comprises increasing or generating the activity of a gene product with the activity of a "RNA polymerase III subunit" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ypr110c or a functional equivalent or a homologue thereof as shown in column 7 of table I, application no. 1, preferably a homologue or functional equivalent as shown in column 7 of table I B, application no. 1, and being depicted in the same respective line as said Ypr110c; or (b) a polypeptide comprising a polypeptide, a consensus sequence or a polypeptide motif as shown in column 5 of table II or in column 7 of table IV, application no. 1, respectively, and being depicted in the same respective line as said Ypr110c or a functional equivalent or a homologue thereof as depicted in column 7 of table II, application no. 1, preferably a homologue or functional equivalent as depicted in column 7 of table II B, application no. 1, and being depicted in the same respective line as said Ypr110c, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "RNA polymerase III subunit", preferably it is the molecule of section (a) or (b) of this paragraph.

In one embodiment, said molecule, which activity is to be increased in the process of the invention and which is the gene product with an activity as described as a "RNA polymerase III subunit", is increased cytoplasmic.

The sequence of B3825_2 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as lysophospholipase.

Accordingly, in one embodiment, the process of the present invention comprises increasing or generating the activity of a gene product with the activity of a "lysophospholipase" from *Escherichia coli* or its functional equivalent or its homolog, e.g. the increase of (a) a gene product of a gene comprising the nucleic acid molecule as shown in column 5 of table I, application no. 1, and being depicted in the same respective line as said B3825_2 or a functional equivalent or a homologue thereof as shown in column 7 of table I, application no. 1, preferably a homologue or functional equivalent as shown in column 7 of table I B, application no. 1, and being depicted in the same respective line as said B3825_2; or (b) a polypeptide comprising a polypeptide, a consensus sequence or a polypeptide motif as shown in column 5 of table II or in column 7 of table IV, application no. 1, respectively, and being depicted in the same respective line as said B3825_2 or a functional equivalent or a homologue thereof as depicted in column 7 of table II, application no.

1, preferably a homologue or functional equivalent as depicted in column 7 of table II B, application no. 1, and being depicted in the same respective line as said B3825__2,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "lysophospholipase", preferably it is the molecule of section (a) or (b) of this paragraph.

In one embodiment, said molecule, which activity is to be increased in the process of the invention and which is the gene product with an activity as described as a "lysophospholipase", is increased plastidic.

The sequence of Yir034c__2 from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as saccharopine dehydrogenase.

Accordingly, in one embodiment, the process of the present invention comprises increasing or generating the activity of a gene product with the activity of a "saccharopine dehydrogenase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yir034c__2 or a functional equivalent or a homologue thereof as shown in column 7 of table I, application no. 1, preferably a homologue or functional equivalent as shown in column 7 of table I B, application no. 1, and being depicted in the same respective line as said Yir034c__2; or (b) a polypeptide comprising a polypeptide, a consensus sequence or a polypeptide motif as shown in column 5 of table II or in column 7 of table IV, application no. 1, respectively, and being depicted in the same respective line as said Yir034c__2 or a functional equivalent or a homologue thereof as depicted in column 7 of table II, application no. 1, preferably a homologue or functional equivalent as depicted in column 7 of table II B, application no. 1, and being depicted in the same respective line as said Yir034c__2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "saccharopine dehydrogenase", preferably it is the molecule of section (a) or (b) of this paragraph.

In one embodiment, said molecule, which activity is to be increased in the process of the invention and which is the gene product with an activity as described as a "saccharopine dehydrogenase", is increased cytoplasmic.

The sequence of Yjr131w__2 from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as alpha-mannosidase.

Accordingly, in one embodiment, the process of the present invention comprises increasing or generating the activity of a gene product with the activity of a "alphamannosidase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yjr131w__2 or a functional equivalent or a homologue thereof as shown in column 7 of table I, application no. 1, preferably a homologue or functional equivalent as shown in column 7 of table I B, application no. 1, and being depicted in the same respective line as said Yjr131w__2; or (b) a polypeptide comprising a polypeptide, a consensus sequence or a polypeptide motif as shown in column 5 of table II or in column 7 of table IV, application no. 1, respectively, and being depicted in the same respective line as said Yjr131w__2 or a functional equivalent or a homologue thereof as depicted in column 7 of table II, application no. 1, preferably a homologue or functional equivalent as depicted in column 7 of table II B, application no. 1, and being depicted in the same respective line as said Yjr131w__2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "alpha-mannosidase", preferably it is the molecule of section (a) or (b) of this paragraph.

In one embodiment, said molecule, which activity is to be increased in the process of the invention and which is the gene product with an activity as described as a "alpha-mannosidase", is increased cytoplasmic.

The sequence of Ykl100c__2 from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ykl100c-protein.

Accordingly, in one embodiment, the process of the present invention comprises increasing or generating the activity of a gene product with the activity of a "ykl100c-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykl100c__2 or a functional equivalent or a homologue thereof as shown in column 7 of table I, application no. 1, preferably a homologue or functional equivalent as shown in column 7 of table I B, application no. 1, and being depicted in the same respective line as said Ykl100c__2; or (b) a polypeptide comprising a polypeptide, a consensus sequence or a polypeptide motif as shown in column 5 of table II or in column 7 of table IV, application no. 1, respectively, and being depicted in the same respective line as said Ykl100c__2 or a functional equivalent or a homologue thereof as depicted in column 7 of table II, application no. 1, preferably a homologue or functional equivalent as depicted in column 7 of table II B, application no. 1, and being depicted in the same respective line as said Ykl100c__2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ykl100c-protein", preferably it is the molecule of section (a) or (b) of this paragraph.

In one embodiment, said molecule, which activity is to be increased in the process of the invention and which is the gene product with an activity as described as a "ykl100c-protein", is increased cytoplasmic.

The sequence of Ykl193c__2 from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as regulatory subunit of Glc7p type 1 protein serine-threonine phosphatase.

Accordingly, in one embodiment, the process of the present invention comprises increasing or generating the activity of a gene product with the activity of a "regulatory subunit of Glc7p type 1 protein serine-threonine phosphatase" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Ykl193c__2 or a functional equivalent or a homologue thereof as shown in column 7 of table I, application no. 1, preferably a homologue or functional equivalent as shown in column 7 of table I B, application no. 1, and being depicted in the same respective line as said Ykl193c__2; or (b) a polypeptide comprising a polypeptide, a consensus sequence or a polypeptide motif as shown in column 5 of table II or in column 7 of table IV, application no. 1, respectively, and being depicted in the same respective line as said Ykl193c__2 or a functional equivalent or a homologue thereof as depicted in column 7 of table II, application no. 1, preferably a homologue or functional equivalent as depicted in column 7 of table II B, application no. 1, and being depicted in the same respective line as said Ykl193c__2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "regulatory subunit of Glc7p type 1 protein serine-threonine phosphatase", preferably it is the molecule of section (a) or (b) of this paragraph.

In one embodiment, said molecule, which activity is to be increased in the process of the invention and which is the gene product with an activity as described as a "regulatory subunit of Glc7p type 1 protein serine-threonine phosphatase", is increased cytoplasmic.

The sequence of Yll016w__2 from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as non-essential Ras guanine nucleotide exchange factor.

Accordingly, in one embodiment, the process of the present invention comprises increasing or generating the activity of a gene product with the activity of a "non-essential Ras guanine nucleotide exchange factor" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said Yll016w__2 or a functional equivalent or a homologue thereof as shown in column 7 of table I, application no. 1, preferably a homologue or functional equivalent as shown in column 7 of table I B, application no. 1, and being depicted in the same respective line as said Yll016w__2; or (b) a polypeptide comprising a polypeptide, a consensus sequence or a polypeptide motif as shown in column 5 of table II or in column 7 of table IV, application no. 1, respectively, and being depicted in the same respective line as said Yll016w__2 or a functional equivalent or a homologue thereof as depicted in column 7 of table II, application no. 1, preferably a homologue or functional equivalent as depicted in column 7 of table II B, application no. 1, and being depicted in the same respective line as said Yll016w__2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "non-essential Ras guanine nucleotide exchange factor", preferably it is the molecule of section (a) or (b) of this paragraph.

In one embodiment, said molecule, which activity is to be increased in the process of the invention and which is the gene product with an activity as described as a "non-essential Ras guanine nucleotide exchange factor", is increased cytoplasmic.

The sequence of Ylr034c__2 from *Saccharomyces cerevisiae*, e.g. as shown in column of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as metal ion transporter.

Accordingly, in one embodiment, the process of the present invention comprises increasing or generating the activity of a gene product with the activity of a "metal ion transporter" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr034c__2 or a functional equivalent or a homologue thereof as shown in column 7 of table I, application no. 1, preferably a homologue or functional equivalent as shown in column 7 of table I B, application no. 1, and being depicted in the same respective line as said Ylr034c__2; or
(b) a polypeptide comprising a polypeptide, a consensus sequence or a polypeptide motif as shown in column 5 of table II or in column 7 of table IV, application no. 1, respectively, and being depicted in the same respective line as said Ylr034c__2 or a functional equivalent or a homologue thereof as depicted in column 7 of table II, application no. 1, preferably a homologue or functional equivalent as depicted in column 7 of table II B, application no. 1, and being depicted in the same respective line as said Ylr034c__2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "metal ion transporter", preferably it is the molecule of section (a) or (b) of this paragraph.

In one embodiment, said molecule, which activity is to be increased in the process of the invention and which is the gene product with an activity as described as a "metal ion transporter", is increased cytoplasmic.

The sequence of Ylr060w__2 from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as subunit of cytoplasmic phenylalanyl-tRNA synthetase.

Accordingly, in one embodiment, the process of the present invention comprises increasing or generating the activity of a gene product with the activity of a "subunit of cytoplasmic phenylalanyl-tRNA synthetase" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ylr060w__2 or a functional equivalent or a homologue thereof as shown in column 7 of table I, application no. 1, preferably a homologue or functional equivalent as shown in column 7 of table I B, application no. 1, and being depicted in the same respective line as said Ylr060w__2; or
(b) a polypeptide comprising a polypeptide, a consensus sequence or a polypeptide motif as shown in column 5 of table II or in column 7 of table IV, application no. 1, respectively, and being depicted in the same respective line as said Ylr060w__2 or a functional equivalent or a homologue thereof as depicted in column 7 of table II, application no. 1, preferably a homologue or functional equivalent as depicted in column 7 of table II B, application no. 1, and being depicted in the same respective line as said Ylr060w__2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "subunit of cytoplasmic phenylalanyl-tRNA synthetase", preferably it is the molecule of section (a) or (b) of this paragraph.

In one embodiment, said molecule, which activity is to be increased in the process of the invention and which is the gene product with an activity as described as a "subunit of cytoplasmic phenylalanyl-tRNA synthetase", is increased cytoplasmic.

The sequence of YMR082C__2 from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YMR082C-protein.

Accordingly, in one embodiment, the process of the present invention comprises increasing or generating the activity of a gene product with the activity of a "YMR082C-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YMR082C__2 or a functional equivalent or a homologue thereof as shown in column 7 of table I, application no. 1, preferably a homologue or functional equivalent as shown in column 7 of table I B, application no. 1, and being depicted in the same respective line as said YMR082C__2; or
(b) a polypeptide comprising a polypeptide, a consensus sequence or a polypeptide motif as shown in column 5 of table II or in column 7 of table IV, application no. 1, respectively, and being depicted in the same respective line as said YMR082C__2 or a functional equivalent or a homologue thereof as depicted in column 7 of table II, application no. 1, preferably a homologue or functional equivalent as depicted in column 7 of table II B, application no. 1, and being depicted in the same respective line as said YMR082C__2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YMR082C-protein", preferably it is the molecule of section (a) or (b) of this paragraph.

In one embodiment, said molecule, which activity is to be increased in the process of the invention and which is the gene product with an activity as described as a "YMR082C-protein", is increased cytoplasmic.

The sequence of B1258 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as B1258-protein.

Accordingly, in one embodiment, the process of the present invention comprises increasing or generating the activity of a gene product with the activity of a "B1258-protein" from *Escherichia coli* or its functional equivalent or its homolog, e.g. the increase of (a) a gene product of a gene comprising the nucleic acid molecule as shown in column 5 of table I, application no. 1, and being depicted in the same respective line as said B1258 or a functional equivalent or a homologue thereof as shown in column 7 of table I, application no. 1, preferably a homologue or functional equivalent as shown in column 7 of table I B, application no. 1, and being depicted in the same respective line as said B1258; or (b) a polypeptide comprising a polypeptide, a consensus sequence or a polypeptide motif as shown in column 5 of table II or in column 7 of table IV, application no. 1, respectively, and being depicted in the same respective line as said B1258 or a functional equivalent or a homologue thereof as depicted in column 7 of table II, application no. 1, preferably a homologue or functional equivalent as depicted in column 7 of table II B, application no. 1, and being depicted in the same respective line as said B1258, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "B1258-protein", preferably it is the molecule of section (a) or (b) of this paragraph.

In one embodiment, said molecule, which activity is to be increased in the process of the invention and which is the gene product with an activity as described as a "B1258-protein", is increased cytoplasmic.

The sequence of YML101C from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YML101C-protein.

Accordingly, in one embodiment, the process of the present invention comprises increasing or generating the activity of a gene product with the activity of a "YML101C-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said YML101C or a functional equivalent or a homologue thereof as shown in column 7 of table I, application no. 1, preferably a homologue or functional equivalent as shown in column 7 of table I B, application no. 1, and being depicted in the same respective line as said YML101C; or (b) a polypeptide comprising a polypeptide, a consensus sequence or a polypeptide motif as shown in column 5 of table II or in column 7 of table IV, application no. 1, respectively, and being depicted in the same respective line as said YML101C or a functional equivalent or a homologue thereof as depicted in column 7 of table II, application no. 1, preferably a homologue or functional equivalent as depicted in column 7 of table II B, application no. 1, and being depicted in the same respective line as said YML101C, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YML101C-protein", preferably it is the molecule of section (a) or (b) of this paragraph.

In one embodiment, said molecule, which activity is to be increased in the process of the invention and which is the gene product with an activity as described as a "YML101C-protein", is increased cytoplasmic.

The sequence of YMR065W from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as nuclear fusion protein precursor.

Accordingly, in one embodiment, the process of the present invention comprises increasing or generating the activity of a gene product with the activity of a "nuclear fusion protein precursor" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said YMR065W or a functional equivalent or a homologue thereof as shown in column 7 of table I, application no. 1, preferably a homologue or functional equivalent as shown in column 7 of table I B, application no. 1, and being depicted in the same respective line as said YMR065W; or (b) a polypeptide comprising a polypeptide, a consensus sequence or a polypeptide motif as shown in column 5 of table II or in column 7 of table IV, application no. 1, respectively, and being depicted in the same respective line as said YMR065W or a functional equivalent or a homologue thereof as depicted in column 7 of table II, application no. 1, preferably a homologue or functional equivalent as depicted in column 7 of table II B, application no. 1, and being depicted in the same respective line as said YMR065W, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "nuclear fusion protein precursor", preferably it is the molecule of section (a) or (b) of this paragraph.

In one embodiment, said molecule, which activity is to be increased in the process of the invention and which is the gene product with an activity as described as a "nuclear fusion protein precursor", is increased cytoplasmic.

The sequence of YMR163c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as inheritance of peroxisomes protein.

Accordingly, in one embodiment, the process of the present invention comprises increasing or generating the activity of a gene product with the activity of a "inheritance of peroxisomes protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YMR163c or a functional equivalent or a homologue thereof as shown in column 7 of table I, application no. 1, preferably a homologue or functional equivalent as shown in column 7 of table I B, application no. 1, and being depicted in the same respective line as said YMR163c; or
(b) a polypeptide comprising a polypeptide, a consensus sequence or a polypeptide motif as shown in column 5 of table II or in column 7 of table IV, application no. 1, respectively, and being depicted in the same respective line as said YMR163c or a functional equivalent or a homologue thereof as depicted in column 7 of table II, application no. 1, preferably a homologue or functional equivalent as depicted in column 7 of table II B, application no. 1, and being depicted in the same respective line as said YMR163c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "inheritance of peroxisomes protein", preferably it is the molecule of section (a) or (b) of this paragraph.

In one embodiment, said molecule, which activity is to be increased in the process of the invention and which is the gene product with an activity as described as a "inheritance of peroxisomes protein", is increased cytoplasmic.

The sequence of YOL042W from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as exoribonuclease.

Accordingly, in one embodiment, the process of the present invention comprises increasing or generating the activity of a gene product with the activity of a "exoribonuclease" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YOL042W or a functional equivalent or a homologue thereof as shown in column 7 of table I, application no. 1, preferably a homologue or functional equivalent as shown in column 7 of table I B, application no. 1, and being depicted in the same respective line as said YOL042W; or
(b) a polypeptide comprising a polypeptide, a consensus sequence or a polypeptide motif as shown in column 5 of table II or in column 7 of table IV, application no. 1, respectively, and being depicted in the same respective line as said YOL042W or a functional equivalent or a homologue thereof as depicted in column 7 of table II, application no. 1, preferably a homologue or functional equivalent as depicted in column 7 of table II B, application no. 1, and being depicted in the same respective line as said YOL042W,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "exoribonuclease", preferably it is the molecule of section (a) or (b) of this paragraph.

In one embodiment, said molecule, which activity is to be increased in the process of the invention and which is the gene product with an activity as described as a "exoribonuclease", is increased cytoplasmic.

The sequence of YOR226c from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as iron sulfur cluster assembly protein.

Accordingly, in one embodiment, the process of the present invention comprises increasing or generating the activity of a gene product with the activity of a "iron sulfur cluster assembly protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YOR226c or a functional equivalent or a homologue thereof as shown in column 7 of table I, application no. 1, preferably a homologue or functional equivalent as shown in column 7 of table I B, application no. 1, and being depicted in the same respective line as said YOR226c; or
(b) a polypeptide comprising a polypeptide, a consensus sequence or a polypeptide motif as shown in column 5 of table II or in column 7 of table IV, application no. 1, respectively, and being depicted in the same respective line as said YOR226c or a functional equivalent or a homologue thereof as depicted in column 7 of table II, application no. 1, preferably a homologue or functional equivalent as depicted in column 7 of table II B, application no. 1, and being depicted in the same respective line as said YOR226c,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "iron sulfur cluster assembly protein", preferably it is the molecule of section (a) or (b) of this paragraph.

In one embodiment, said molecule, which activity is to be increased in the process of the invention and which is the gene product with an activity as described as a "iron sulfur cluster assembly protein", is increased cytoplasmic.

The sequence of YPL068C from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YPL068C-protein.

Accordingly, in one embodiment, the process of the present invention comprises increasing or generating the activity of a gene product with the activity of a "YPL068C-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YPL068C or a functional equivalent or a homologue thereof as shown in column 7 of table I, application no. 1, preferably a homologue or functional equivalent as shown in column 7 of table I B, application no. 1, and being depicted in the same respective line as said YPL068C; or
(b) a polypeptide comprising a polypeptide, a consensus sequence or a polypeptide motif as shown in column 5 of table II or in column 7 of table IV, application no. 1, respectively, and being depicted in the same respective line as said YPL068C or a functional equivalent or a homologue thereof as depicted in column 7 of table II, application no. 1, preferably a homologue or functional equivalent as depicted in column 7 of table II B, application no. 1, and being depicted in the same respective line as said YPL068C,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YPL068C-protein", preferably it is the molecule of section (a) or (b) of this paragraph.

In one embodiment, said molecule, which activity is to be increased in the process of the invention and which is the gene product with an activity as described as a "YPL068C-protein", is increased cytoplasmic.

The sequence of B0165 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as B0165-protein.

Accordingly, in one embodiment, the process of the present invention comprises increasing or generating the activity of a gene product with the activity of a "B0165-protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B0165 or a functional equivalent or a homologue thereof as shown in column 7 of table I, application no. 1, preferably a homologue or functional equivalent as shown in column 7 of table I B, application no. 1, and being depicted in the same respective line as said B0165; or
(b) a polypeptide comprising a polypeptide, a consensus sequence or a polypeptide motif as shown in column 5 of table II or in column 7 of table IV, application no. 1, respectively, and being depicted in the same respective line as said B0165 or a functional equivalent or a homologue thereof as depicted in column 7 of table II, application no. 1, preferably a homologue or functional equivalent as depicted in column 7 of table II B, application no. 1, and being depicted in the same respective line as said B0165,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "B0165-protein", preferably it is the molecule of section (a) or (b) of this paragraph.

In one embodiment, said molecule, which activity is to be increased in the process of the invention and which is the gene product with an activity as described as a "B0165-protein", is increased plastidic.

The sequence of YOR203W from *Saccharomyces cerevisiae*, e.g. as shown in column of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YOR203W-protein.

Accordingly, in one embodiment, the process of the present invention comprises increasing or generating the activity of a gene product with the activity of a "YOR203W-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YOR203W or a functional equivalent or a homologue thereof as shown in column 7 of table I, application no. 1, preferably a homologue or functional equivalent as shown in column 7 of table I B, application no. 1, and being depicted in the same respective line as said YOR203W; or
(b) a polypeptide comprising a polypeptide, a consensus sequence or a polypeptide motif as shown in column 5 of table II or in column 7 of table IV, application no. 1, respectively, and being depicted in the same respective line as said YOR203W or a functional equivalent or a homologue thereof as depicted in column 7 of table II, application no. 1, preferably a homologue or functional equivalent as depicted in column 7 of table II B, application no. 1, and being depicted in the same respective line as said YOR203W, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YOR203W-protein", preferably it is the molecule of section (a) or (b) of this paragraph.

In one embodiment, said molecule, which activity is to be increased in the process of the invention and which is the gene product with an activity as described as a "YOR203W-protein", is increased cytoplasmic.

The sequence of YNL147W from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as ribonucleoprotein.

Accordingly, in one embodiment, the process of the present invention comprises increasing or generating the activity of a gene product with the activity of a "ribonucleoprotein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YNL147W or a functional equivalent or a homologue thereof as shown in column 7 of table I, application no. 1, preferably a homologue or functional equivalent as shown in column 7 of table I B, application no. 1, and being depicted in the same respective line as said YNL147W; or
(b) a polypeptide comprising a polypeptide, a consensus sequence or a polypeptide motif as shown in column 5 of table II or in column 7 of table IV, application no. 1, respectively, and being depicted in the same respective line as said YNL147W or a functional equivalent or a homologue thereof as depicted in column 7 of table II, application no. 1, preferably a homologue or functional equivalent as depicted in column 7 of table II B, application no. 1, and being depicted in the same respective line as said YNL147W,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "ribonucleoprotein", preferably it is the molecule of section (a) or (b) of this paragraph.

In one embodiment, said molecule, which activity is to be increased in the process of the invention and which is the gene product with an activity as described as a "ribonucleoprotein", is increased cytoplasmic.

The sequence of YBR083W from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as transcription factor.

Accordingly, in one embodiment, the process of the present invention comprises increasing or generating the activity of a gene product with the activity of a "transcription factor" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YBR083W or a functional equivalent or a homologue thereof as shown in column 7 of table I, application no. 1, preferably a homologue or functional equivalent as shown in column 7 of table I B, application no. 1, and being depicted in the same respective line as said YBR083W; or
(b) a polypeptide comprising a polypeptide, a consensus sequence or a polypeptide motif as shown in column 5 of table II or in column 7 of table IV, application no. 1, respectively, and being depicted in the same respective line as said YBR083W or a functional equivalent or a homologue thereof as depicted in column 7 of table II, application no. 1, preferably a homologue or functional equivalent as depicted in column 7 of table II B, application no. 1, and being depicted in the same respective line as said YBR083W,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "transcription factor", preferably it is the molecule of section (a) or (b) of this paragraph.

In one embodiment, said molecule, which activity is to be increased in the process of the invention and which is the gene product with an activity as described as a "transcription factor", is increased cytoplasmic.

The sequence of YKL111C from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YKL111C-protein.

Accordingly, in one embodiment, the process of the present invention comprises increasing or generating the activity of a gene product with the activity of a "YKL111C-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YKL111C or a functional equivalent or a homologue thereof as shown in column 7 of table I, application no. 1, preferably a homologue or functional equivalent as shown in column 7 of table I B, application no. 1, and being depicted in the same respective line as said YKL111C; or
(b) a polypeptide comprising a polypeptide, a consensus sequence or a polypeptide motif as shown in column 5 of table II or in column 7 of table IV, application no. 1, respectively, and being depicted in the same respective line as said YKL111C or a functional equivalent or a homologue thereof as depicted in column 7 of table II, application no. 1, preferably a homologue or functional equivalent as depicted in column 7 of table II B, application no. 1, and being depicted in the same respective line as said YKL111C,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YKL111C-protein", preferably it is the molecule of section (a) or (b) of this paragraph.

In one embodiment, said molecule, which activity is to be increased in the process of the invention and which is the gene product with an activity as described as a "YKL111C-protein", is increased cytoplasmic.

The sequence of YPR067W from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as iron sulfur cluster assembly protein.

Accordingly, in one embodiment, the process of the present invention comprises increasing or generating the activity of a gene product with the activity of a "iron sulfur cluster assembly protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YPR067W or a functional equivalent or a homologue thereof as shown in column 7 of table I, application no. 1, preferably a homologue or functional equivalent as shown in column 7 of table I B, application no. 1, and being depicted in the same respective line as said YPR067W; or
(b) a polypeptide comprising a polypeptide, a consensus sequence or a polypeptide motif as shown in column 5 of table II or in column 7 of table IV, application no. 1, respectively, and being depicted in the same respective line as said YPR067W or a functional equivalent or a homologue thereof as depicted in column 7 of table II, application no. 1, preferably a homologue or functional equivalent as depicted in column 7 of table II B, application no. 1, and being depicted in the same respective line as said YPR067W,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "iron sulfur cluster assembly protein", preferably it is the molecule of section (a) or (b) of this paragraph.

In one embodiment, said molecule, which activity is to be increased in the process of the invention and which is the gene product with an activity as described as a "iron sulfur cluster assembly protein", is increased cytoplasmic.

The sequence of B1985 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as transport protein.

Accordingly, in one embodiment, the process of the present invention comprises increasing or generating the activity of a gene product with the activity of a "transport protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B1985 or a functional equivalent or a homologue thereof as shown in column 7 of table I, application no. 1, preferably a homologue or functional equivalent as shown in column 7 of table I B, application no. 1, and being depicted in the same respective line as said B1985; or
(b) a polypeptide comprising a polypeptide, a consensus sequence or a polypeptide motif as shown in column 5 of table II or in column 7 of table IV, application no. 1, respectively, and being depicted in the same respective line as said B1985 or a functional equivalent or a homologue thereof as depicted in column 7 of table II, application no. 1, preferably a homologue or functional equivalent as depicted in column 7 of table II B, application no. 1, and being depicted in the same respective line as said B1985,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "transport protein", preferably it is the molecule of section (a) or (b) of this paragraph.

In one embodiment, said molecule, which activity is to be increased in the process of the invention and which is the gene product with an activity as described as a "transport protein", is increased cytoplasmic.

The sequence of B3838 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as protein translocase protein.

Accordingly, in one embodiment, the process of the present invention comprises increasing or generating the activity of a gene product with the activity of a "protein translocase protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B3838 or a functional equivalent or a homologue thereof as shown in column 7 of table I, application no. 1, preferably a homologue or functional equivalent as shown in column 7 of table I B, application no. 1, and being depicted in the same respective line as said B3838; or
(b) a polypeptide comprising a polypeptide, a consensus sequence or a polypeptide motif as shown in column 5 of table II or in column 7 of table IV, application no. 1, respectively, and being depicted in the same respective line as said B3838 or a functional equivalent or a homologue thereof as depicted in column 7 of table II, application no. 1, preferably a homologue or functional equivalent as depicted in column 7 of table II B, application no. 1, and being depicted in the same respective line as said B3838, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "protein translocase protein", preferably it is the molecule of section (a) or (b) of this paragraph.

In one embodiment, said molecule, which activity is to be increased in the process of the invention and which is the gene product with an activity as described as a "protein translocase protein", is increased cytoplasmic.

The sequence of YJL010C from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YJL010C-protein.

Accordingly, in one embodiment, the process of the present invention comprises increasing or generating the activity of a gene product with the activity of a "YJL010C-protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YJL010C or a functional equivalent or a homologue thereof as shown in column 7 of table I, application no. 1, preferably a homologue or functional equivalent as shown in column 7 of table I B, application no. 1, and being depicted in the same respective line as said YJL010C; or
(b) a polypeptide comprising a polypeptide, a consensus sequence or a polypeptide motif as shown in column 5 of table II or in column 7 of table IV, application no. 1, respectively, and being depicted in the same respective line as said YJL010C or a functional equivalent or a homologue thereof as depicted in column 7 of table II, application no. 1, preferably a homologue or functional equivalent as depicted in column 7 of table II B, application no. 1, and being depicted in the same respective line as said YJL010C,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YJL010C-protein", preferably it is the molecule of section (a) or (b) of this paragraph.

In one embodiment, said molecule, which activity is to be increased in the process of the invention and which is the gene product with an activity as described as a "YJL010C-protein", is increased cytoplasmic.

The sequence of B1267 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as B1267-protein.

Accordingly, in one embodiment, the process of the present invention comprises increasing or generating the activity of a gene product with the activity of a "B1267-protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B1267 or a functional equivalent or a homologue thereof as shown in column 7 of table I, application no. 1, preferably a homologue or functional equivalent as shown in column 7 of table I B, application no. 1, and being depicted in the same respective line as said B1267; or
(b) a polypeptide comprising a polypeptide, a consensus sequence or a polypeptide motif as shown in column 5 of table II or in column 7 of table IV, application no. 1, respectively, and being depicted in the same respective line as said B1267 or a functional equivalent or a homologue thereof as depicted in column 7 of table II, application no. 1, preferably a homologue or functional equivalent as depicted in column 7 of table II B, application no. 1, and being depicted in the same respective line as said B1267,
as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "B1267-protein", preferably it is the molecule of section (a) or (b) of this paragraph.

In one embodiment, said molecule, which activity is to be increased in the process of the invention and which is the gene product with an activity as described as a "B1267-protein", is increased cytoplasmic.

The sequence of B1322 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as membrane protein.

Accordingly, in one embodiment, the process of the present invention comprises increasing or generating the activity of a gene product with the activity of a "membrane protein" from *Escherichia coli* or its functional equivalent or its homolog, e.g. the increase of
(a) a gene product of a gene comprising the nucleic acid molecule as shown in column 5 of table I, application no. 1, and being depicted in the same respective line as said B1322 or a functional equivalent or a homologue thereof as shown in column 7 of table I, application no. 1, preferably a homologue or functional equivalent as shown in column 7 of table I B, application no. 1, and being depicted in the same respective line as said B1322; or (b) a polypeptide comprising a polypeptide, a consensus sequence or a polypeptide motif as shown in column 5 of table II or in column 7 of table IV, application no. 1, respectively, and being depicted in the same respective line as said B1322 or a functional equivalent or a homologue thereof as depicted in column 7 of table II, application no. 1, preferably a homologue or functional equivalent as depicted in column 7 of table II B, application no. 1, and being depicted in the same respective line as said B1322, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "membrane protein", preferably it is the molecule of section (a) or (b) of this paragraph.

In one embodiment, said molecule, which activity is to be increased in the process of the invention and which is the gene product with an activity as described as a "membrane protein", is increased cytoplasmic.

The sequence of B1381 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as B1381-protein.

Accordingly, in one embodiment, the process of the present invention comprises increasing or generating the activity of a gene product with the activity of a "B1381-protein" from *Escherichia coli* or its functional equivalent or its homolog, e.g. the increase of (a) a gene product of a gene comprising the nucleic acid molecule as shown in column 5 of table I, application no. 1, and being depicted in the same respective line as said B1381 or a functional equivalent or a homologue thereof as shown in column 7 of table I, application no. 1, preferably a homologue or functional equivalent as shown in column 7 of table I B, application no. 1, and being depicted in the same respective line as said B1381; or (b) a polypeptide comprising a polypeptide, a consensus sequence or a polypeptide motif as shown in column 5 of table II or in column 7 of table IV, application no. 1, respectively, and being depicted in the same respective line as said B1381 or a functional equivalent or a homologue thereof as depicted in column 7 of table II, application no. 1, preferably a homologue or functional equivalent as depicted in column 7 of table II B, application no. 1, and being depicted in the same respective line as said B1381, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "B1381-protein", preferably it is the molecule of section (a) or (b) of this paragraph.

In one embodiment, said molecule, which activity is to be increased in the process of the invention and which is the gene product with an activity as described as a "B1381-protein", is increased cytoplasmic.

The sequence of B2646 from *Escherichia coli*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as B2646-protein.

Accordingly, in one embodiment, the process of the present invention comprises increasing or generating the activity of a gene product with the activity of a "B2646-protein" from *Escherichia coli* or its functional equivalent or its homolog, e.g. the increase of (a) a gene product of a gene comprising the nucleic acid molecule as shown in column 5 of table I, application no. 1, and being depicted in the same respective line as said B2646 or a functional equivalent or a homologue thereof as shown in column 7 of table I, application no. 1, preferably a homologue or functional equivalent as shown in column 7 of table I B, application no. 1, and being depicted in the same respective line as said B2646; or (b) a polypeptide comprising a polypeptide, a consensus sequence or a polypeptide motif as shown in column 5 of table II or in column 7 of table IV, application no. 1, respectively, and being depicted in the same respective line as said B2646 or a functional equivalent or a homologue thereof as depicted in column 7 of table II, application no. 1, preferably a homologue or functional equivalent as depicted in column 7 of table II B, application no. 1, and being depicted in the same respective line as said B2646, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "B2646-protein", preferably it is the molecule of section (a) or (b) of this paragraph.

In one embodiment, said molecule, which activity is to be increased in the process of the invention and which is the gene product with an activity as described as a "B2646-protein", is increased cytoplasmic.

The sequence of YBR191W from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as 60S ribosomal protein.

Accordingly, in one embodiment, the process of the present invention comprises increasing or generating the activity of a gene product with the activity of a "60S ribosomal protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said YBR191W or a functional equivalent or a homologue thereof as shown in column 7 of table I, application no. 1, preferably a homologue or functional equivalent as shown in column 7 of table I B, application no. 1, and being depicted in the same respective line as said YBR191W; or (b) a polypeptide comprising a polypeptide, a consensus sequence or a polypeptide motif as shown in column 5 of table II or in column 7 of table IV, application no. 1, respectively, and being depicted in the same respective line as said YBR191W or a functional equivalent or a homologue thereof as depicted in column 7 of table II, application no. 1, preferably a homologue or functional equivalent as depicted in column 7 of table II B, application no. 1, and being depicted in the same respective line as said YBR191W, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "60S ribosomal protein", preferably it is the molecule of section (a) or (b) of this paragraph.

In one embodiment, said molecule, which activity is to be increased in the process of the invention and which is the gene product with an activity as described as a "60S ribosomal protein", is increased cytoplasmic.

The sequence of YDL135C from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Rho GDP-dissociation inhibitor.

Accordingly, in one embodiment, the process of the present invention comprises increasing or generating the activity of a gene product with the activity of a "Rho GDP-dissociation inhibitor" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said YDL135C or a functional equivalent or a homologue thereof as shown in column 7 of table I, application no. 1, preferably a homologue or functional equivalent as shown in column 7 of table I B, application no. 1, and being depicted in the same respective line as said YDL135C; or (b) a polypeptide comprising a polypeptide, a consensus sequence or a polypeptide motif as shown in column 5 of table II or in column 7 of table IV, application no. 1, respectively, and being depicted in the same respective line as said YDL135C or a functional equivalent or a homologue thereof as depicted in column 7 of table II, application no. 1, preferably a homologue or functional equivalent as depicted in column 7 of table II B, application no. 1, and being depicted in the same respective line as said YDL135C, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Rho GDP-dissociation inhibitor", preferably it is the molecule of section (a) or (b) of this paragraph.

In one embodiment, said molecule, which activity is to be increased in the process of the invention and which is the gene product with an activity as described as a "Rho GDP-dissociation inhibitor", is increased cytoplasmic.

The sequence of YHL005C from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as YHL005C-protein.

Accordingly, in one embodiment, the process of the present invention comprises increasing or generating the activity of a gene product with the activity of a "YHL005C-protein" from *Saccharomyces cerevisiae* or its functional equivalent or its homolog, e.g. the increase of (a) a gene product of a gene comprising the nucleic acid molecule as shown in column 5 of table I, application no. 1, and being depicted in the same respective line as said YHL005C or a functional equivalent or a homologue thereof as shown in column 7 of table I, application no. 1, preferably a homologue or functional equivalent as shown in column 7 of table I B, application no. 1, and being depicted in the same respective line as said YHL005C; or (b) a polypeptide comprising a polypeptide, a consensus sequence or a polypeptide motif as shown in column 5 of table II or in column 7 of table IV, application no. 1, respectively, and being depicted in the same respective line as said YHL005C or a functional equivalent or a homologue thereof as depicted in column 7 of table II, application no. 1, preferably a homologue or functional equivalent as depicted in column 7 of table II B, application no. 1, and being depicted in the same respective line as said YHL005C, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "YHL005C-protein", preferably it is the molecule of section (a) or (b) of this paragraph.

In one embodiment, said molecule, which activity is to be increased in the process of the invention and which is the gene product with an activity as described as a "YHL005C-protein", is increased cytoplasmic.

The sequence of YKR100C_2 from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as transmembrane protein with a role in cell wall polymer composition.

Accordingly, in one embodiment, the process of the present invention comprises increasing or generating the activity of a gene product with the activity of a "transmembrane protein with a role in cell wall polymer composition"

from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said YKR1000_2 or a functional equivalent or a homologue thereof as shown in column 7 of table I, application no. 1, preferably a homologue or functional equivalent as shown in column 7 of table I B, application no. 1, and being depicted in the same respective line as said YKR100C_2; or
(b) a polypeptide comprising a polypeptide, a consensus sequence or a polypeptide motif as shown in column 5 of table II or in column 7 of table IV, application no. 1, respectively, and being depicted in the same respective line as said YKR100C_2 or a functional equivalent or a homologue thereof as depicted in column 7 of table II, application no. 1, preferably a homologue or functional equivalent as depicted in column 7 of table II B, application no. 1, and being depicted in the same respective line as said YKR100C_2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "transmembrane protein with a role in cell wall polymer composition", preferably it is the molecule of section (a) or (b) of this paragraph.

In one embodiment, said molecule, which activity is to be increased in the process of the invention and which is the gene product with an activity as described as a "transmembrane protein with a role in cell wall polymer composition", is increased cytoplasmic.

The sequence of Ymr191w_2 from *Saccharomyces cerevisiae*, e.g. as shown in column 5 of table I, application no. 1, is published (e.g. sequences from *Saccharomyces cerevisiae* have been published in Goffeau et al., Science 274 (5287), 546 (1996), sequences from *Escherichia coli* have been published in Blattner et al., Science 277 (5331), 1453 (1997)), and/or its activity is described as Stationary phase protein.

Accordingly, in one embodiment, the process of the present invention comprises increasing or generating the activity of a gene product with the activity of a "Stationary phase protein" from *Saccharomyces cerevisiae* or its functional equivalent or its homolog, e.g. the increase of
(a) a gene product of a gene comprising the nucleic acid molecule as shown in column 5 of table I, application no. 1, and being depicted in the same respective line as said Ymr191w_2 or a functional equivalent or a homologue thereof as shown in column 7 of table I, application no. 1, preferably a homologue or functional equivalent as shown in column 7 of table I B, application no. 1, and being depicted in the same respective line as said Ymr191w_2; or
(b) a polypeptide comprising a polypeptide, a consensus sequence or a polypeptide motif as shown in column 5 of table II or in column 7 of table IV, application no. 1, respectively, and being depicted in the same respective line as said Ymr191w_2 or a functional equivalent or a homologue thereof as depicted in column 7 of table II, application no. 1, preferably a homologue or functional equivalent as depicted in column 7 of table II B, application no. 1, and being depicted in the same respective line as said Ymr191w_2, as mentioned herein, for an increased yield, especially an enhanced NUE and/or increased biomass production, as compared to a corresponding non-transformed wild type plant cell, plant or part thereof in plant cell, plant or part thereof, as mentioned, especially for an enhanced NUE, or increased biomass production, or an enhanced NUE and increased biomass production.

Accordingly, in one embodiment, the molecule which activity is to be increased in the process of the invention is the gene product with an activity of described as a "Stationary phase protein", preferably it is the molecule of section (a) or (b) of this paragraph.

In one embodiment, said molecule, which activity is to be increased in the process of the invention and which is the gene product with an activity as described as a "Stationary phase protein", is increased cytoplasmic.

Surprisingly, it was observed that an increasing or generating of at least one gene conferring an activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease or of a gene comprising a nucleic acid sequence described in column 5 of table I, application no. 1, in a plant conferred an increased yield, especially an enhanced NUE and/or increased biomass production, in the transformed plants as compared to a corresponding non-transformed wild type plant, especially an enhanced NUE, or an increased biomass production, or an enhanced NUE and increased biomass production.

Surprisingly, it was observed that an increasing or generating of at least one gene conferring an activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease or of a gene comprising a nucleic acid sequence described in column 5 of table I, application no. 1, in *Arabidopsis thaliana* conferred an increased yield, especially an enhanced NUE and/or increased biomass production in the transformed plants as compared to a corresponding non-transformed wild type plant, especially an enhanced NUE, or an increased biomass production, or an enhanced NUE and increased biomass production.

In particular, it was observed that increasing or generating the activity of a gene product with the activity of a "b0017-protein" encoded by a gene comprising the nucleic acid sequence SEQ ID NO. 38 or a nucleic acid which differs from the nucleic acid SEQ ID NO. 38 by exchanging the stop codon taa by tga in *Arabidopsis thaliana* conferred an increased yield, especially an increased NUE than the wild type control.

It was further observed that increasing or generating the activity of a gene product with the activity of a "b0017-protein" encoded by a gene comprising the nucleic acid sequence SEQ ID NO.: 38 or a nucleic acid which differs from the nucleic acid SEQ ID NO. 38 by exchanging the stop codon taa by tga in *Arabidopsis thaliana* conferred an increased biomass production compared with the wild type control.

It was further observed that increasing or generating the activity of a gene product with the activity of a "b0017-protein" encoded by a gene comprising the nucleic acid sequence SEQ ID NO. 38 or a nucleic acid which differs from the nucleic acid SEQ ID NO. 38 by exchanging the stop codon taa by tga in *Arabidopsis thaliana* conferred an increased NUE and an increased biomass production compared with the wild type control.

In particular, it was observed that increasing or generating the activity of a gene product with the activity of a "transport protein" encoded by a gene comprising the nucleic acid sequence SEQ ID NO. 42 in *Arabidopsis thaliana* conferred an increased yield, especially an increased NUE compared with the wild type control.

It was further observed that increasing or generating the activity of a gene product with the activity of a "transport protein" encoded by a gene comprising the nucleic acid sequence SEQ ID NO.: 42 in *Arabidopsis thaliana* conferred an increased biomass production compared with the wild type control.

It was further observed that increasing or generating the activity of a gene product with the activity of a "transport protein" encoded by a gene comprising the nucleic acid sequence SEQ ID NO. 42 in *Arabidopsis thaliana* conferred an increased NUE and an increased biomass production compared with the wild type control.

In particular, it was observed that increasing or generating the activity of a gene product with the activity of a "hydroxy-myristol acyl carrier protein dehydratase" encoded by a gene comprising the nucleic acid sequence SEQ ID NO. 123 or a nucleic acid which differs from the nucleic acid SEQ ID NO. 123 by exchanging the stop codon taa by tga in *Arabidopsis thaliana* conferred an increased yield, especially an increased NUE compared with the wild type control.

It was further observed that increasing or generating the activity of a gene product with the activity of a "hydroxy-myristol acyl carrier protein dehydratase" encoded by a gene comprising the nucleic acid sequence SEQ ID NO.: 123 or a nucleic acid which differs from the nucleic acid SEQ ID NO. 123 by exchanging the stop codon taa by tga in *Arabidopsis thaliana* conferred an increased biomass production compared with the wild type control.

It was further observed that increasing or generating the activity of a gene product with the activity of a "hydroxy-myristol acyl carrier protein dehydratase" encoded by a gene comprising the nucleic acid sequence SEQ ID NO. 123 or a nucleic acid which differs from the nucleic acid SEQ ID NO. 123 by exchanging the stop codon taa by tga in *Arabidopsis thaliana* conferred an increased NUE and an increased biomass production compared with the wild type control.

In particular, it was observed that increasing or generating the activity of a gene product with the activity of a "gamma-glutamyl kinase" encoded by a gene comprising the nucleic acid sequence SEQ ID NO. 380 in *Arabidopsis thaliana* conferred an increased yield, especially an increased NUE compared with the wild type control.

It was further observed that increasing or generating the activity of a gene product with the activity of a "gamma-glutamyl kinase" encoded by a gene comprising the nucleic acid sequence SEQ ID NO.: 380 in *Arabidopsis thaliana* conferred an increased biomass production compared with the wild type control.

It was further observed that increasing or generating the activity of a gene product with the activity of a "gamma-glutamyl kinase" encoded by a gene comprising the nucleic acid sequence SEQ ID NO. 380 in *Arabidopsis thaliana* conferred an increased NUE and an increased biomass production compared with the wild type control.

In particular, it was observed that increasing or generating the activity of a gene product with the activity of a "alpha-glucosidase" encoded by a gene comprising the nucleic acid sequence SEQ ID NO. 679 in *Arabidopsis thaliana* conferred an increased yield, especially an increased NUE compared with the wild type control.

It was further observed that increasing or generating the activity of a gene product with the activity of a "alpha-glucosidase" encoded by a gene comprising the nucleic acid sequence SEQ ID NO.: 679 in *Arabidopsis thaliana* conferred an increased biomass production compared with the wild type control.

It was further observed that increasing or generating the activity of a gene product with the activity of a "alpha-glucosidase" encoded by a gene comprising the nucleic acid sequence SEQ ID NO. 679 in *Arabidopsis thaliana* conferred an increased NUE and an increased biomass production compared with the wild type control.

In particular, it was observed that increasing or generating the activity of a gene product with the activity of a "adenylate kinase" encoded by a gene comprising the nucleic acid sequence SEQ ID NO. 812 in *Arabidopsis thaliana* conferred an increased yield, especially an increased NUE compared with the wild type control.

It was further observed that increasing or generating the activity of a gene product with the activity of a "adenylate kinase" encoded by a gene comprising the nucleic acid sequence SEQ ID NO.: 812 in *Arabidopsis thaliana* conferred an increased biomass production compared with the wild type control.

It was further observed that increasing or generating the activity of a gene product with the activity of a "adenylate kinase" encoded by a gene comprising the nucleic acid sequence SEQ ID NO. 812 in *Arabidopsis thaliana* conferred an increased NUE and an increased biomass production compared with the wild type control.

In particular, it was observed that increasing or generating the activity of a gene product with the activity of a "2-dehydro-3-deoxy-phosphoheptonate aldolase" encoded by a gene comprising the nucleic acid sequence SEQ ID NO. 1055 in *Arabidopsis thaliana* conferred an increased yield, especially an increased NUE compared with the wild type control.

It was further observed that increasing or generating the activity of a gene product with the activity of a "2-dehydro-3-deoxy-phosphoheptonate aldolase" encoded by a gene comprising the nucleic acid sequence SEQ ID NO.: 1055 in *Arabidopsis thaliana* conferred an increased biomass production compared with the wild type control.

It was further observed that increasing or generating the activity of a gene product with the activity of a "2-dehydro-3-deoxy-phosphoheptonate aldolase" encoded by a gene comprising the nucleic acid sequence SEQ ID NO. 1055 in *Arabidopsis thaliana* conferred an increased NUE and an increased biomass production compared with the wild type control.

In particular, it was observed that increasing or generating the activity of a gene product with the activity of a "molybdopterin biosynthesis protein" encoded by a gene comprising the nucleic acid sequence SEQ ID NO. 1563 in *Arabidopsis thaliana* conferred an increased yield, especially an increased NUE compared with the wild type control.

It was further observed that increasing or generating the activity of a gene product with the activity of a "molybdopterin biosynthesis protein" encoded by a gene comprising the nucleic acid sequence SEQ ID NO.: 1563 in *Arabidopsis thaliana* conferred an increased biomass production compared with the wild type control.

It was further observed that increasing or generating the activity of a gene product with the activity of a "molybdopterin biosynthesis protein" encoded by a gene comprising the nucleic acid sequence SEQ ID NO. 1563 in *Arabidopsis thaliana* conferred an increased NUE and an increased biomass production compared with the wild type control.

In particular, it was observed that increasing or generating the activity of a gene product with the activity of a "hydroxylamine reductase" encoded by a gene comprising the nucleic acid sequence SEQ ID NO. 1705 in *Arabidopsis thaliana* conferred an increased yield, especially an increased NUE compared with the wild type control.

It was further observed that increasing or generating the activity of a gene product with the activity of a "hydroxylamine reductase" encoded by a gene comprising the nucleic acid sequence SEQ ID NO.: 1705 in *Arabidopsis thaliana* conferred an increased biomass production compared with the wild type control.

It was further observed that increasing or generating the activity of a gene product with the activity of a "hydroxylamine reductase" encoded by a gene comprising the nucleic acid sequence SEQ ID NO. 1705 in *Arabidopsis thaliana* conferred an increased NUE and an increased biomass production compared with the wild type control.

In particular, it was observed that increasing or generating the activity of a gene product with the activity of a "proline dehydrogenase" encoded by a gene comprising the nucleic acid sequence SEQ ID NO. 1844 in *Arabidopsis thaliana* conferred an increased yield, especially an increased NUE compared with the wild type control.

It was further observed that increasing or generating the activity of a gene product with the activity of a "proline dehydrogenase" encoded by a gene comprising the nucleic acid sequence SEQ ID NO.: 1844 in *Arabidopsis thaliana* conferred an increased biomass production compared with the wild type control.

It was further observed that increasing or generating the activity of a gene product with the activity of a "proline dehydrogenase" encoded by a gene comprising the nucleic acid sequence SEQ ID NO. 1844 in *Arabidopsis thaliana* conferred an increased NUE and an increased biomass production compared with the wild type control.

In particular, it was observed that increasing or generating the activity of a gene product with the activity of a "PhoH-like protein" encoded by a gene comprising the nucleic acid sequence SEQ ID NO. 1950 in *Arabidopsis thaliana* conferred an increased yield, especially an increased NUE compared with the wild type control.

It was further observed that increasing or generating the activity of a gene product with the activity of a "PhoH-like protein" encoded by a gene comprising the nucleic acid sequence SEQ ID NO.: 1950 in *Arabidopsis thaliana* conferred an increased biomass production compared with the wild type control.

It was further observed that increasing or generating the activity of a gene product with the activity of a "PhoH-like protein" encoded by a gene comprising the nucleic acid sequence SEQ ID NO. 1950 in *Arabidopsis thaliana* conferred an increased NUE and an increased biomass production compared with the wild type control.

In particular, it was observed that increasing or generating the activity of a gene product with the activity of a "isomerase" encoded by a gene comprising the nucleic acid sequence SEQ ID NO. 1975 in *Arabidopsis thaliana* conferred an increased yield, especially an increased NUE compared with the wild type control.

It was further observed that increasing or generating the activity of a gene product with the activity of a "isomerase" encoded by a gene comprising the nucleic acid sequence SEQ ID NO.: 1975 in *Arabidopsis thaliana* conferred an increased biomass production compared with the wild type control.

It was further observed that increasing or generating the activity of a gene product with the activity of a "isomerase" encoded by a gene comprising the nucleic acid sequence SEQ ID NO. 1975 in *Arabidopsis thaliana* conferred an increased NUE and an increased biomass production compared with the wild type control.

In particular, it was observed that increasing or generating the activity of a gene product with the activity of a "b1933-protein" encoded by a gene comprising the nucleic acid sequence SEQ ID NO. 2127 or a nucleic acid which differs from the nucleic acid SEQ ID NO. 2127 by exchanging the stop codon taa by tga in *Arabidopsis thaliana* conferred an increased yield, especially an increased NUE compared with the wild type control.

It was further observed that increasing or generating the activity of a gene product with the activity of a "b1933-protein" encoded by a gene comprising the nucleic acid sequence SEQ ID NO.: 2127 or a nucleic acid which differs from the nucleic acid SEQ ID NO. 2127 by exchanging the stop codon taa by tga in *Arabidopsis thaliana* conferred an increased biomass production compared with the wild type control.

It was further observed that increasing or generating the activity of a gene product with the activity of a "b1933-protein" encoded by a gene comprising the nucleic acid sequence SEQ ID NO. 2127 or a nucleic acid which differs from the nucleic acid SEQ ID NO. 2127 by exchanging the stop codon taa by tga in *Arabidopsis thaliana* conferred an increased NUE and an increased biomass production compared with the wild type control.

In particular, it was observed that increasing or generating the activity of a gene product with the activity of a "glycosyltransferase" encoded by a gene comprising the nucleic acid sequence SEQ ID NO. 2135 or a nucleic acid which differs from the nucleic acid SEQ ID NO. 2135 by exchanging the stop codon taa by tga in *Arabidopsis thaliana* conferred an increased yield, especially an increased NUE compared with the wild type control.

It was further observed that increasing or generating the activity of a gene product with the activity of a "glycosyltransferase" encoded by a gene comprising the nucleic acid sequence SEQ ID NO.: 2135 or a nucleic acid which differs from the nucleic acid SEQ ID NO. 2135 by exchanging the stop codon taa by tga in *Arabidopsis thaliana* conferred an increased biomass production compared with the wild type control.

It was further observed that increasing or generating the activity of a gene product with the activity of a "glycosyltransferase" encoded by a gene comprising the nucleic acid sequence SEQ ID NO. 2135 or a nucleic acid which differs from the nucleic acid SEQ ID NO. 2135 by exchanging the stop codon taa by tga in *Arabidopsis thaliana* conferred an increased NUE and an increased biomass production compared with the wild type control.

In particular, it was observed that increasing or generating the activity of a gene product with the activity of a "b2165-protein" encoded by a gene comprising the nucleic acid sequence SEQ ID NO. 2171 in *Arabidopsis thaliana* conferred an increased yield, especially an increased NUE compared with the wild type control.

It was further observed that increasing or generating the activity of a gene product with the activity of a "b2165-protein" encoded by a gene comprising the nucleic acid sequence SEQ ID NO.: 2171 in *Arabidopsis thaliana* conferred an increased biomass production compared with the wild type control.

It was further observed that increasing or generating the activity of a gene product with the activity of a "b2165-protein" encoded by a gene comprising the nucleic acid sequence SEQ ID NO. 2171 in *Arabidopsis thaliana* conferred an increased NUE and an increased biomass production compared with the wild type control.

In particular, it was observed that increasing or generating the activity of a gene product with the activity of a "short chain fatty acid transporter" encoded by a gene comprising the nucleic acid sequence SEQ ID NO. 2297 or a nucleic acid which differs from the nucleic acid SEQ ID NO. 2297 by exchanging the stop codon taa by tga in *Arabidopsis thaliana* conferred an increased yield, especially an increased NUE compared with the wild type control.

It was further observed that increasing or generating the activity of a gene product with the activity of a "short chain fatty acid transporter" encoded by a gene comprising the nucleic acid sequence SEQ ID NO.: 2297 or a nucleic acid which differs from the nucleic acid SEQ ID NO. 2297 by exchanging the stop codon taa by tga in *Arabidopsis thaliana* conferred an increased biomass production compared with the wild type control.

It was further observed that increasing or generating the activity of a gene product with the activity of a "short chain fatty acid transporter" encoded by a gene comprising the nucleic acid sequence SEQ ID NO. 2297 or a nucleic acid which differs from the nucleic acid SEQ ID NO. 2297 by exchanging the stop codon taa by tga in *Arabidopsis thaliana* conferred an increased NUE and an increased biomass production compared with the wild type control.

In particular, it was observed that increasing or generating the activity of a gene product with the activity of a "b2238-protein" encoded by a gene comprising the nucleic acid sequence SEQ ID NO. 2426 or a nucleic acid which differs from the nucleic acid SEQ ID NO. 2426 by exchanging the stop codon taa by tga in *Arabidopsis thaliana* conferred an increased yield, especially an increased NUE compared with the wild type control.

It was further observed that increasing or generating the activity of a gene product with the activity of a "b2238-protein" encoded by a gene comprising the nucleic acid sequence SEQ ID NO.: 2426 or a nucleic acid which differs from the nucleic acid SEQ ID NO. 2426 by exchanging the stop codon taa by tga in *Arabidopsis thaliana* conferred an increased biomass production compared with the wild type control.

It was further observed that increasing or generating the activity of a gene product with the activity of a "b2238-protein" encoded by a gene comprising the nucleic acid sequence SEQ ID NO. 2426 or a nucleic acid which differs from the nucleic acid SEQ ID NO. 2426 by exchanging the stop codon taa by tga in *Arabidopsis thaliana* conferred an increased NUE and an increased biomass production compared with the wild type control.

In particular, it was observed that increasing or generating the activity of a gene product with the activity of a "lysine/arginine/ornithine transporter subunit" encoded by a gene comprising the nucleic acid sequence SEQ ID NO. 2452 or a nucleic acid which differs from the nucleic acid SEQ ID NO. 2452 by exchanging the stop codon taa by tga in *Arabidopsis thaliana* conferred an increased yield, especially an increased NUE compared with the wild type control.

It was further observed that increasing or generating the activity of a gene product with the activity of a "lysine/arginine/ornithine transporter subunit" encoded by a gene comprising the nucleic acid sequence SEQ ID NO.: 2452 or a nucleic acid which differs from the nucleic acid SEQ ID NO. 2452 by exchanging the stop codon taa by tga in *Arabidopsis thaliana* conferred an increased biomass production compared with the wild type control.

It was further observed that increasing or generating the activity of a gene product with the activity of a "lysine/arginine/ornithine transporter subunit" encoded by a gene comprising the nucleic acid sequence SEQ ID NO. 2452 or a nucleic acid which differs from the nucleic acid SEQ ID NO. 2452 by exchanging the stop codon taa by tga in *Arabidopsis thaliana* conferred an increased NUE and an increased biomass production compared with the wild type control.

In particular, it was observed that increasing or generating the activity of a gene product with the activity of a "b2431-protein" encoded by a gene comprising the nucleic acid sequence SEQ ID NO. 2551 in *Arabidopsis thaliana* conferred an increased yield, especially an increased NUE compared with the wild type control.

It was further observed that increasing or generating the activity of a gene product with the activity of a "b2431-protein" encoded by a gene comprising the nucleic acid sequence SEQ ID NO.: 2551 in *Arabidopsis thaliana* conferred an increased biomass production compared with the wild type control.

It was further observed that increasing or generating the activity of a gene product with the activity of a "b2431-protein" encoded by a gene comprising the nucleic acid sequence SEQ ID NO. 2551 in *Arabidopsis thaliana* conferred an increased NUE and an increased biomass production compared with the wild type control.

In particular, it was observed that increasing or generating the activity of a gene product with the activity of a "chorismate mutase T/prephenate dehydrogenase (bifunctional)" encoded by a gene comprising the nucleic acid sequence SEQ ID NO. 2600 in *Arabidopsis thaliana* conferred an increased yield, especially an increased NUE compared with the wild type control.

It was further observed that increasing or generating the activity of a gene product with the activity of a "chorismate mutase T/prephenate dehydrogenase (bifunctional)" encoded by a gene comprising the nucleic acid sequence SEQ ID NO.: 2600 in *Arabidopsis thaliana* conferred an increased biomass production compared with the wild type control.

It was further observed that increasing or generating the activity of a gene product with the activity of a "chorismate mutase T/prephenate dehydrogenase (bifunctional)" encoded by a gene comprising the nucleic acid sequence SEQ ID NO. 2600 in *Arabidopsis thaliana* conferred an increased NUE and an increased biomass production compared with the wild type control.

In particular, it was observed that increasing or generating the activity of a gene product with the activity of a "b2766-protein" encoded by a gene comprising the nucleic acid sequence SEQ ID NO. 2668 in *Arabidopsis thaliana* conferred an increased yield, especially an increased NUE compared with the wild type control.

It was further observed that increasing or generating the activity of a gene product with the activity of a "b2766-protein" encoded by a gene comprising the nucleic acid sequence SEQ ID NO.: 2668 in *Arabidopsis thaliana* conferred an increased biomass production compared with the wild type control.

It was further observed that increasing or generating the activity of a gene product with the activity of a "b2766-protein" encoded by a gene comprising the nucleic acid sequence SEQ ID NO. 2668 in *Arabidopsis thaliana* conferred an increased NUE and an increased biomass production compared with the wild type control.

In particular, it was observed that increasing or generating the activity of a gene product with the activity of a "glycine decarboxylase" encoded by a gene comprising the nucleic acid sequence SEQ ID NO. 2772 in *Arabidopsis thaliana* conferred an increased yield, especially an increased NUE compared with the wild type control.

It was further observed that increasing or generating the activity of a gene product with the activity of a "glycine decarboxylase" encoded by a gene comprising the nucleic acid sequence SEQ ID NO.: 2772 in *Arabidopsis thaliana* conferred an increased biomass production compared with the wild type control.

It was further observed that increasing or generating the activity of a gene product with the activity of a "glycine decarboxylase" encoded by a gene comprising the nucleic acid sequence SEQ ID NO. 2772 in *Arabidopsis thaliana* conferred an increased NUE and an increased biomass production compared with the wild type control.

In particular, it was observed that increasing or generating the activity of a gene product with the activity of a "threonine ammonia-lyase" encoded by a gene comprising the nucleic acid sequence SEQ ID NO. 3117 in *Arabidopsis thaliana* conferred an increased yield, especially an increased NUE compared with the wild type control.

It was further observed that increasing or generating the activity of a gene product with the activity of a "threonine ammonia-lyase" encoded by a gene comprising the nucleic acid sequence SEQ ID NO.: 3117 in *Arabidopsis thaliana* conferred an increased biomass production compared with the wild type control.

It was further observed that increasing or generating the activity of a gene product with the activity of a "threonine ammonia-lyase" encoded by a gene comprising the nucleic acid sequence SEQ ID NO. 3117 in *Arabidopsis thaliana* conferred an increased NUE and an increased biomass production compared with the wild type control.

In particular, it was observed that increasing or generating the activity of a gene product with the activity of a "b3120-protein" encoded by a gene comprising the nucleic acid sequence SEQ ID NO. 3390 or a nucleic acid which differs from the nucleic acid SEQ ID NO. 3390 by exchanging the stop codon taa by tga in *Arabidopsis thaliana* conferred an increased yield, especially an increased NUE compared with the wild type control.

It was further observed that increasing or generating the activity of a gene product with the activity of a "b3120-protein" encoded by a gene comprising the nucleic acid sequence SEQ ID NO.: 3390 or a nucleic acid which differs from the nucleic acid SEQ ID NO. 3390 by exchanging the stop codon taa by tga in *Arabidopsis thaliana* conferred an increased biomass production compared with the wild type control.

It was further observed that increasing or generating the activity of a gene product with the activity of a "b3120-protein" encoded by a gene comprising the nucleic acid sequence SEQ ID NO. 3390 or a nucleic acid which differs from the nucleic acid SEQ ID NO. 3390 by exchanging the stop codon taa by tga in *Arabidopsis thaliana* conferred an increased NUE and an increased biomass production compared with the wild type control.

In particular, it was observed that increasing or generating the activity of a gene product with the activity of a "outer membrane usher protein" encoded by a gene comprising the nucleic acid sequence SEQ ID NO. 3396 in *Arabidopsis thaliana* conferred an increased yield, especially an increased NUE compared with the wild type control.

It was further observed that increasing or generating the activity of a gene product with the activity of a "outer membrane usher protein" encoded by a gene comprising the nucleic acid sequence SEQ ID NO.: 3396 in *Arabidopsis thaliana* conferred an increased biomass production compared with the wild type control.

It was further observed that increasing or generating the activity of a gene product with the activity of a "outer membrane usher protein" encoded by a gene comprising the nucleic acid sequence SEQ ID NO. 3396 in *Arabidopsis thaliana* conferred an increased NUE and an increased biomass production compared with the wild type control.

In particular, it was observed that increasing or generating the activity of a gene product with the activity of a "glycerol-3-phosphate transporter subunit" encoded by a gene comprising the nucleic acid sequence SEQ ID NO. 3470 in *Arabidopsis thaliana* conferred an increased yield, especially an increased NUE compared with the wild type control.

It was further observed that increasing or generating the activity of a gene product with the activity of a "glycerol-3-phosphate transporter subunit" encoded by a gene comprising the nucleic acid sequence SEQ ID NO.: 3470 in *Arabidopsis thaliana* conferred an increased biomass production compared with the wild type control.

It was further observed that increasing or generating the activity of a gene product with the activity of a "glycerol-3-phosphate transporter subunit" encoded by a gene comprising the nucleic acid sequence SEQ ID NO. 3470 in *Arabidopsis thaliana* conferred an increased NUE and an increased biomass production compared with the wild type control.

In particular, it was observed that increasing or generating the activity of a gene product with the activity of a "hydro-lyase" encoded by a gene comprising the nucleic acid sequence SEQ ID NO. 3563 or a nucleic acid which differs from the nucleic acid SEQ ID NO. 3563 by exchanging the stop codon taa by tga in *Arabidopsis thaliana* conferred an increased yield, especially an increased NUE compared with the wild type control.

It was further observed that increasing or generating the activity of a gene product with the activity of a "hydro-lyase" encoded by a gene comprising the nucleic acid sequence SEQ ID NO.: 3563 or a nucleic acid which differs from the nucleic acid SEQ ID NO. 3563 by exchanging the stop codon taa by tga in *Arabidopsis thaliana* conferred an increased biomass production compared with the wild type control.

It was further observed that increasing or generating the activity of a gene product with the activity of a "hydro-lyase" encoded by a gene comprising the nucleic acid sequence SEQ ID NO. 3563 or a nucleic acid which differs from the nucleic acid SEQ ID NO. 3563 by exchanging the stop codon taa by tga in *Arabidopsis thaliana* conferred an increased NUE and an increased biomass production compared with the wild type control.

In particular, it was observed that increasing or generating the activity of a gene product with the activity of a "lysophospholipase" encoded by a gene comprising the nucleic acid sequence SEQ ID NO. 3770 in *Arabidopsis thaliana* conferred an increased yield, especially an increased NUE compared with the wild type control.

It was further observed that increasing or generating the activity of a gene product with the activity of a "lysophospholipase" encoded by a gene comprising the nucleic acid sequence SEQ ID NO.: 3770 in *Arabidopsis thaliana* conferred an increased biomass production compared with the wild type control.

It was further observed that increasing or generating the activity of a gene product with the activity of a "lysophospholipase" encoded by a gene comprising the nucleic acid sequence SEQ ID NO. 3770 in *Arabidopsis thaliana* conferred an increased NUE and an increased biomass production compared with the wild type control.

In particular, it was observed that increasing or generating the activity of a gene product with the activity of a "yal019w-protein" encoded by a gene comprising the nucleic acid sequence SEQ ID NO. 3868 in *Arabidopsis thaliana* conferred an increased yield, especially an increased NUE compared with the wild type control.

It was further observed that increasing or generating the activity of a gene product with the activity of a "yal019w-protein" encoded by a gene comprising the nucleic acid sequence SEQ ID NO.: 3868 in *Arabidopsis thaliana* conferred an increased biomass production compared with the wild type control.

It was further observed that increasing or generating the activity of a gene product with the activity of a "yal019w-protein" encoded by a gene comprising the nucleic acid sequence SEQ ID NO. 3868 in *Arabidopsis thaliana* conferred an increased NUE and an increased biomass production compared with the wild type control.

In particular, it was observed that increasing or generating the activity of a gene product with the activity of a "carnitine acetyltransferase" encoded by a gene comprising the nucleic acid sequence SEQ ID NO. 3895 in *Arabidopsis thaliana* conferred an increased yield, especially an increased NUE compared with the wild type control.

It was further observed that increasing or generating the activity of a gene product with the activity of a "carnitine acetyltransferase" encoded by a gene comprising the nucleic acid sequence SEQ ID NO.: 3895 in *Arabidopsis thaliana* conferred an increased biomass production compared with the wild type control.

It was further observed that increasing or generating the activity of a gene product with the activity of a "carnitine acetyltransferase" encoded by a gene comprising the nucleic acid sequence SEQ ID NO. 3895 in *Arabidopsis thaliana* conferred an increased NUE and an increased biomass production compared with the wild type control.

In particular, it was observed that increasing or generating the activity of a gene product with the activity of a "Transcriptional activator" encoded by a gene comprising the nucleic acid sequence SEQ ID NO. 3953 in *Arabidopsis thaliana* conferred an increased yield, especially an increased NUE compared with the wild type control.

It was further observed that increasing or generating the activity of a gene product with the activity of a "Transcriptional activator" encoded by a gene comprising the nucleic acid sequence SEQ ID NO.: 3953 in *Arabidopsis thaliana* conferred an increased biomass production compared with the wild type control.

It was further observed that increasing or generating the activity of a gene product with the activity of a "Transcriptional activator" encoded by a gene comprising the nucleic acid sequence SEQ ID NO. 3953 in *Arabidopsis thaliana* conferred an increased NUE and an increased biomass production compared with the wild type control.

In particular, it was observed that increasing or generating the activity of a gene product with the activity of a "splicing factor" encoded by a gene comprising the nucleic acid sequence SEQ ID NO. 4111 in *Arabidopsis thaliana* conferred an increased yield, especially an increased NUE compared with the wild type control.

It was further observed that increasing or generating the activity of a gene product with the activity of a "splicing factor" encoded by a gene comprising the nucleic acid sequence SEQ ID NO.: 4111 in *Arabidopsis thaliana* conferred an increased biomass production compared with the wild type control.

It was further observed that increasing or generating the activity of a gene product with the activity of a "splicing factor" encoded by a gene comprising the nucleic acid sequence SEQ ID NO. 4111 in *Arabidopsis thaliana* conferred an increased NUE and an increased biomass production compared with the wild type control.

In particular, it was observed that increasing or generating the activity of a gene product with the activity of a "autophagy-specific phosphatidylinositol 3-kinase complex protein subunit" encoded by a gene comprising the nucleic acid sequence SEQ ID NO. 4149 in *Arabidopsis thaliana* conferred an increased yield, especially an increased NUE compared with the wild type control.

It was further observed that increasing or generating the activity of a gene product with the activity of a "autophagy-specific phosphatidylinositol 3-kinase complex protein subunit" encoded by a gene comprising the nucleic acid sequence SEQ ID NO.: 4149 in *Arabidopsis thaliana* conferred an increased biomass production compared with the wild type control.

It was further observed that increasing or generating the activity of a gene product with the activity of a "autophagy-specific phosphatidylinositol 3-kinase complex protein subunit" encoded by a gene comprising the nucleic acid sequence SEQ ID NO. 4149 in *Arabidopsis thaliana* conferred an increased NUE and an increased biomass production compared with the wild type control.

In particular, it was observed that increasing or generating the activity of a gene product with the activity of a "microsomal beta-keto-reductase" encoded by a gene comprising the nucleic acid sequence SEQ ID NO. 4162 in *Arabidopsis thaliana* conferred an increased yield, especially an increased NUE compared with the wild type control.

It was further observed that increasing or generating the activity of a gene product with the activity of a "microsomal beta-keto-reductase" encoded by a gene comprising the nucleic acid sequence SEQ ID NO.: 4162 in *Arabidopsis thaliana* conferred an increased biomass production compared with the wild type control.

It was further observed that increasing or generating the activity of a gene product with the activity of a "microsomal beta-keto-reductase" encoded by a gene comprising the nucleic acid sequence SEQ ID NO. 4162 in *Arabidopsis thaliana* conferred an increased NUE and an increased biomass production compared with the wild type control.

In particular, it was observed that increasing or generating the activity of a gene product with the activity of a "UDP-N-acetyl-glucosamine-1-P transferase" encoded by a gene comprising the nucleic acid sequence SEQ ID NO. 4235 in *Arabidopsis thaliana* conferred an increased yield, especially an increased NUE compared with the wild type control.

It was further observed that increasing or generating the activity of a gene product with the activity of a "UDP-N-acetyl-glucosamine-1-P transferase" encoded by a gene comprising the nucleic acid sequence SEQ ID NO.: 4235 in *Arabidopsis thaliana* conferred an increased biomass production compared with the wild type control.

It was further observed that increasing or generating the activity of a gene product with the activity of a "UDP-N-acetyl-glucosamine-1-P transferase" encoded by a gene comprising the nucleic acid sequence SEQ ID NO. 4235 in *Arabidopsis thaliana* conferred an increased NUE and an increased biomass production compared with the wild type control.

In particular, it was observed that increasing or generating the activity of a gene product with the activity of a "ybr262c-protein" encoded by a gene comprising the nucleic acid sequence SEQ ID NO. 4280 in *Arabidopsis thaliana* conferred an increased yield, especially an increased NUE compared with the wild type control.

It was further observed that increasing or generating the activity of a gene product with the activity of a "ybr262c-protein" encoded by a gene comprising the nucleic acid sequence SEQ ID NO.: 4280 in *Arabidopsis thaliana* conferred an increased biomass production compared with the wild type control.

It was further observed that increasing or generating the activity of a gene product with the activity of a "ybr262c-protein" encoded by a gene comprising the nucleic acid sequence SEQ ID NO. 4280 in *Arabidopsis thaliana* conferred an increased NUE and an increased biomass production compared with the wild type control.

In particular, it was observed that increasing or generating the activity of a gene product with the activity of a "protein necessary for structural stability of L-A double-stranded RNA-containing particles" encoded by a gene comprising the nucleic acid sequence SEQ ID NO. 4288 in *Arabidopsis thaliana* conferred an increased yield, especially an increased NUE compared with the wild type control.

It was further observed that increasing or generating the activity of a gene product with the activity of a "protein necessary for structural stability of L-A double-stranded RNA-containing particles" encoded by a gene comprising the nucleic acid sequence SEQ ID NO.: 4288 in *Arabidopsis thaliana* conferred an increased biomass production compared with the wild type control.

It was further observed that increasing or generating the activity of a gene product with the activity of a "protein necessary for structural stability of L-A double-stranded RNA-containing particles" encoded by a gene comprising the nucleic acid sequence SEQ ID NO. 4288 in *Arabidopsis thaliana* conferred an increased NUE and an increased biomass production compared with the wild type control.

In particular, it was observed that increasing or generating the activity of a gene product with the activity of a "YDR070C-protein" encoded by a gene comprising the nucleic acid sequence SEQ ID NO. 4315 in *Arabidopsis thaliana* conferred an increased yield, especially an increased NUE compared with the wild type control.

It was further observed that increasing or generating the activity of a gene product with the activity of a "YDR070C-protein" encoded by a gene comprising the nucleic acid sequence SEQ ID NO.: 4315 in *Arabidopsis thaliana* conferred an increased biomass production compared with the wild type control.

It was further observed that increasing or generating the activity of a gene product with the activity of a "YDR070C-protein" encoded by a gene comprising the nucleic acid sequence SEQ ID NO. 4315 in *Arabidopsis thaliana* conferred an increased NUE and an increased biomass production compared with the wild type control.

In particular, it was observed that increasing or generating the activity of a gene product with the activity of a "chaperone" encoded by a gene comprising the nucleic acid sequence SEQ ID NO. 4325 in *Arabidopsis thaliana* conferred an increased yield, especially an increased NUE compared with the wild type control.

It was further observed that increasing or generating the activity of a gene product with the activity of a "chaperone" encoded by a gene comprising the nucleic acid sequence SEQ ID NO.: 4325 in *Arabidopsis thaliana* conferred an increased biomass production compared with the wild type control.

It was further observed that increasing or generating the activity of a gene product with the activity of a "chaperone" encoded by a gene comprising the nucleic acid sequence SEQ ID NO. 4325 in *Arabidopsis thaliana* conferred an increased NUE and an increased biomass production compared with the wild type control.

In particular, it was observed that increasing or generating the activity of a gene product with the activity of a "helix-loop-helix transcription activator that binds inositol/choline-responsive elements" encoded by a gene comprising the nucleic acid sequence SEQ ID NO. 4335 in *Arabidopsis thaliana* conferred an increased yield, especially an increased NUE compared with the wild type control.

It was further observed that increasing or generating the activity of a gene product with the activity of a "helix-loop-helix transcription activator that binds inositol/choline-responsive elements" encoded by a gene comprising the nucleic acid sequence SEQ ID NO.: 4335 in *Arabidopsis thaliana* conferred an increased biomass production compared with the wild type control.

It was further observed that increasing or generating the activity of a gene product with the activity of a "helix-loop-helix transcription activator that binds inositol/choline-responsive elements" encoded by a gene comprising the nucleic acid sequence SEQ ID NO. 4335 in *Arabidopsis thaliana* conferred an increased NUE and an increased biomass production compared with the wild type control.

In particular, it was observed that increasing or generating the activity of a gene product with the activity of a "golgi membrane exchange factor subunit" encoded by a gene comprising the nucleic acid sequence SEQ ID NO. 4346 in *Arabidopsis thaliana* conferred an increased yield, especially an increased NUE compared with the wild type control.

It was further observed that increasing or generating the activity of a gene product with the activity of a "golgi membrane exchange factor subunit" encoded by a gene comprising the nucleic acid sequence SEQ ID NO.: 4346 in *Arabidopsis thaliana* conferred an increased biomass production compared with the wild type control.

It was further observed that increasing or generating the activity of a gene product with the activity of a "golgi membrane exchange factor subunit" encoded by a gene comprising the nucleic acid sequence SEQ ID NO. 4346 in *Arabidopsis thaliana* conferred an increased NUE and an increased biomass production compared with the wild type control.

In particular, it was observed that increasing or generating the activity of a gene product with the activity of a "dihydrosphingosine phosphate lyase" encoded by a gene comprising the nucleic acid sequence SEQ ID NO. 4361 in *Arabidopsis thaliana* conferred an increased yield, especially an increased NUE compared with the wild type control.

It was further observed that increasing or generating the activity of a gene product with the activity of a "dihydrosphingosine phosphate lyase" encoded by a gene comprising the nucleic acid sequence SEQ ID NO.: 4361 in *Arabidopsis thaliana* conferred an increased biomass production compared with the wild type control.

It was further observed that increasing or generating the activity of a gene product with the activity of a "dihydrosphingosine phosphate lyase" encoded by a gene comprising the nucleic acid sequence SEQ ID NO. 4361 in *Arabidopsis thaliana* conferred an increased NUE and an increased biomass production compared with the wild type control.

In particular, it was observed that increasing or generating the activity of a gene product with the activity of a "ubiquitin regulatory protein" encoded by a gene comprising the nucleic acid sequence SEQ ID NO. 4402 in *Arabidopsis thaliana* conferred an increased yield, especially an increased NUE compared with the wild type control.

It was further observed that increasing or generating the activity of a gene product with the activity of a "ubiquitin regulatory protein" encoded by a gene comprising the nucleic acid sequence SEQ ID NO.: 4402 in *Arabidopsis thaliana* conferred an increased biomass production compared with the wild type control.

It was further observed that increasing or generating the activity of a gene product with the activity of a "ubiquitin regulatory protein" encoded by a gene comprising the nucleic acid sequence SEQ ID NO. 4402 in *Arabidopsis thaliana* conferred an increased NUE and an increased biomass production compared with the wild type control.

In particular, it was observed that increasing or generating the activity of a gene product with the activity of a "ydr355c-protein" encoded by a gene comprising the nucleic acid sequence SEQ ID NO. 4431 in *Arabidopsis thaliana* conferred an increased yield, especially an increased NUE compared with the wild type control.

It was further observed that increasing or generating the activity of a gene product with the activity of a "ydr355c-protein" encoded by a gene comprising the nucleic acid sequence SEQ ID NO.: 4431 in *Arabidopsis thaliana* conferred an increased biomass production compared with the wild type control.

It was further observed that increasing or generating the activity of a gene product with the activity of a "ydr355c-protein" encoded by a gene comprising the nucleic acid sequence SEQ ID NO. 4431 in *Arabidopsis thaliana* conferred an increased NUE and an increased biomass production compared with the wild type control.

In particular, it was observed that increasing or generating the activity of a gene product with the activity of a "lysine-specific metalloprotease" encoded by a gene comprising the nucleic acid sequence SEQ ID NO. 4435 in *Arabidopsis thaliana* conferred an increased yield, especially an increased NUE compared with the wild type control.

It was further observed that increasing or generating the activity of a gene product with the activity of a "lysine-specific metalloprotease" encoded by a gene comprising the nucleic acid sequence SEQ ID NO.: 4435 in *Arabidopsis thaliana* conferred an increased biomass production compared with the wild type control.

It was further observed that increasing or generating the activity of a gene product with the activity of a "lysine-specific metalloprotease" encoded by a gene comprising the nucleic acid sequence SEQ ID NO. 4435 in *Arabidopsis thaliana* conferred an increased NUE and an increased biomass production compared with the wild type control.

In particular, it was observed that increasing or generating the activity of a gene product with the activity of a "subunit of the transport protein particle (TRAPP) complex of the cis-Golgi" encoded by a gene comprising the nucleic acid sequence SEQ ID NO. 4485 in *Arabidopsis thaliana* conferred an increased yield, especially an increased NUE compared with the wild type control.

It was further observed that increasing or generating the activity of a gene product with the activity of a "subunit of the transport protein particle (TRAPP) complex of the cis-Golgi" encoded by a gene comprising the nucleic acid sequence SEQ ID NO.: 4485 in *Arabidopsis thaliana* conferred an increased biomass production compared with the wild type control.

It was further observed that increasing or generating the activity of a gene product with the activity of a "subunit of the transport protein particle (TRAPP) complex of the cis-Golgi" encoded by a gene comprising the nucleic acid sequence SEQ ID NO. 4485 in *Arabidopsis thaliana* conferred an increased NUE and an increased biomass production compared with the wild type control.

In particular, it was observed that increasing or generating the activity of a gene product with the activity of a "myo-inositol transporter" encoded by a gene comprising the nucleic acid sequence SEQ ID NO. 4506 in *Arabidopsis thaliana* conferred an increased yield, especially an increased NUE compared with the wild type control.

It was further observed that increasing or generating the activity of a gene product with the activity of a "myo-inositol transporter" encoded by a gene comprising the nucleic acid sequence SEQ ID NO.: 4506 in *Arabidopsis thaliana* conferred an increased biomass production compared with the wild type control.

It was further observed that increasing or generating the activity of a gene product with the activity of a "myo-inositol transporter" encoded by a gene comprising the nucleic acid sequence SEQ ID NO. 4506 in *Arabidopsis thaliana* conferred an increased NUE and an increased biomass production compared with the wild type control.

In particular, it was observed that increasing or generating the activity of a gene product with the activity of a "SM complex B protein for mRNA splicing" encoded by a gene comprising the nucleic acid sequence SEQ ID NO. 4790 in *Arabidopsis thaliana* conferred an increased yield, especially an increased NUE compared with the wild type control.

It was further observed that increasing or generating the activity of a gene product with the activity of a "SM complex B protein for mRNA splicing" encoded by a gene comprising the nucleic acid sequence SEQ ID NO.: 4790 in *Arabidopsis thaliana* conferred an increased biomass production compared with the wild type control.

It was further observed that increasing or generating the activity of a gene product with the activity of a "SM complex B protein for mRNA splicing" encoded by a gene comprising the nucleic acid sequence SEQ ID NO. 4790 in *Arabidopsis thaliana* conferred an increased NUE and an increased biomass production compared with the wild type control.

In particular, it was observed that increasing or generating the activity of a gene product with the activity of a "YFR007W-protein" encoded by a gene comprising the nucleic acid sequence SEQ ID NO. 4806 in *Arabidopsis thaliana* conferred an increased yield, especially an increased NUE compared with the wild type control.

It was further observed that increasing or generating the activity of a gene product with the activity of a "YFR007W-protein" encoded by a gene comprising the nucleic acid sequence SEQ ID NO.: 4806 in *Arabidopsis thaliana* conferred an increased biomass production compared with the wild type control.

It was further observed that increasing or generating the activity of a gene product with the activity of a "YFR007W-protein" encoded by a gene comprising the nucleic acid sequence SEQ ID NO. 4806 in *Arabidopsis thaliana* conferred an increased NUE and an increased biomass production compared with the wild type control.

In particular, it was observed that increasing or generating the activity of a gene product with the activity of a "oxidoreductase" encoded by a gene comprising the nucleic acid sequence SEQ ID NO. 4836 in *Arabidopsis thaliana* conferred an increased yield, especially an increased NUE compared with the wild type control.

It was further observed that increasing or generating the activity of a gene product with the activity of a "oxidoreductase" encoded by a gene comprising the nucleic acid sequence SEQ ID NO.: 4836 in *Arabidopsis thaliana* conferred an increased biomass production compared with the wild type control.

It was further observed that increasing or generating the activity of a gene product with the activity of a "oxidoreductase" encoded by a gene comprising the nucleic acid sequence SEQ ID NO. 4836 in *Arabidopsis thaliana* conferred an increased NUE and an increased biomass production compared with the wild type control.

In particular, it was observed that increasing or generating the activity of a gene product with the activity of a "transcription elongation factor" encoded by a gene comprising the nucleic acid sequence SEQ ID NO. 5311 in *Arabidopsis thaliana* conferred an increased yield, especially an increased NUE compared with the wild type control.

It was further observed that increasing or generating the activity of a gene product with the activity of a "transcription elongation factor" encoded by a gene comprising the nucleic acid sequence SEQ ID NO.: 5311 in *Arabidopsis thaliana* conferred an increased biomass production compared with the wild type control.

It was further observed that increasing or generating the activity of a gene product with the activity of a "transcription elongation factor" encoded by a gene comprising the nucleic acid sequence SEQ ID NO. 5311 in *Arabidopsis thaliana* conferred an increased NUE and an increased biomass production compared with the wild type control.

In particular, it was observed that increasing or generating the activity of a gene product with the activity of a "cytosolic catalase" encoded by a gene comprising the nucleic acid sequence SEQ ID NO. 5346 in *Arabidopsis thaliana* conferred an increased yield, especially an increased NUE compared with the wild type control.

It was further observed that increasing or generating the activity of a gene product with the activity of a "cytosolic catalase" encoded by a gene comprising the nucleic acid sequence SEQ ID NO.: 5346 in *Arabidopsis thaliana* conferred an increased biomass production compared with the wild type control.

It was further observed that increasing or generating the activity of a gene product with the activity of a "cytosolic catalase" encoded by a gene comprising the nucleic acid sequence SEQ ID NO. 5346 in *Arabidopsis thaliana* conferred an increased NUE and an increased biomass production compared with the wild type control.

In particular, it was observed that increasing or generating the activity of a gene product with the activity of a "ygr122c-a-protein" encoded by a gene comprising the nucleic acid sequence SEQ ID NO. 5533 in *Arabidopsis thaliana* conferred an increased yield, especially an increased NUE compared with the wild type control.

It was further observed that increasing or generating the activity of a gene product with the activity of a "ygr122c-a-protein" encoded by a gene comprising the nucleic acid sequence SEQ ID NO.: 5533 in *Arabidopsis thaliana* conferred an increased biomass production compared with the wild type control.

It was further observed that increasing or generating the activity of a gene product with the activity of a "ygr122c-a-protein" encoded by a gene comprising the nucleic acid sequence SEQ ID NO. 5533 in *Arabidopsis thaliana* conferred an increased NUE and an increased biomass production compared with the wild type control.

In particular, it was observed that increasing or generating the activity of a gene product with the activity of a "v-SNARE binding protein" encoded by a gene comprising the nucleic acid sequence SEQ ID NO. 5551 in *Arabidopsis thaliana* conferred an increased yield, especially an increased NUE compared with the wild type control.

It was further observed that increasing or generating the activity of a gene product with the activity of a "v-SNARE binding protein" encoded by a gene comprising the nucleic acid sequence SEQ ID NO.: 5551 in *Arabidopsis thaliana* conferred an increased biomass production compared with the wild type control.

It was further observed that increasing or generating the activity of a gene product with the activity of a "v-SNARE binding protein" encoded by a gene comprising the nucleic acid sequence SEQ ID NO. 5551 in *Arabidopsis thaliana* conferred an increased NUE and an increased biomass production compared with the wild type control.

In particular, it was observed that increasing or generating the activity of a gene product with the activity of a "protein involved in sphingolipid biosynthesis" encoded by a gene comprising the nucleic acid sequence SEQ ID NO. 5559 in

*Arabidopsis thaliana* conferred an increased yield, especially an increased NUE compared with the wild type control.

It was further observed that increasing or generating the activity of a gene product with the activity of a "protein involved in sphingolipid biosynthesis" encoded by a gene comprising the nucleic acid sequence SEQ ID NO.: 5559 in *Arabidopsis thaliana* conferred an increased biomass production compared with the wild type control.

It was further observed that increasing or generating the activity of a gene product with the activity of a "protein involved in sphingolipid biosynthesis" encoded by a gene comprising the nucleic acid sequence SEQ ID NO. 5559 in *Arabidopsis thaliana* conferred an increased NUE and an increased biomass production compared with the wild type control.

In particular, it was observed that increasing or generating the activity of a gene product with the activity of a "mitochondrial ribosomal protein of the small subunit" encoded by a gene comprising the nucleic acid sequence SEQ ID NO. 5602 in *Arabidopsis thaliana* conferred an increased yield, especially an increased NUE compared with the wild type control.

It was further observed that increasing or generating the activity of a gene product with the activity of a "mitochondrial ribosomal protein of the small subunit" encoded by a gene comprising the nucleic acid sequence SEQ ID NO.: 5602 in *Arabidopsis thaliana* conferred an increased biomass production compared with the wild type control.

It was further observed that increasing or generating the activity of a gene product with the activity of a "mitochondrial ribosomal protein of the small subunit" encoded by a gene comprising the nucleic acid sequence SEQ ID NO. 5602 in *Arabidopsis thaliana* conferred an increased NUE and an increased biomass production compared with the wild type control.

In particular, it was observed that increasing or generating the activity of a gene product with the activity of a "phosphatidylserine decarboxylase" encoded by a gene comprising the nucleic acid sequence SEQ ID NO. 5608 in *Arabidopsis thaliana* conferred an increased yield, especially an increased NUE compared with the wild type control.

It was further observed that increasing or generating the activity of a gene product with the activity of a "phosphatidylserine decarboxylase" encoded by a gene comprising the nucleic acid sequence SEQ ID NO.: 5608 in *Arabidopsis thaliana* conferred an increased biomass production compared with the wild type control.

It was further observed that increasing or generating the activity of a gene product with the activity of a "phosphatidylserine decarboxylase" encoded by a gene comprising the nucleic acid sequence SEQ ID NO. 5608 in *Arabidopsis thaliana* conferred an increased NUE and an increased biomass production compared with the wild type control.

In particular, it was observed that increasing or generating the activity of a gene product with the activity of a "cholinephosphate cytidylyltransferase" encoded by a gene comprising the nucleic acid sequence SEQ ID NO. 5614 in *Arabidopsis thaliana* conferred an increased yield, especially an increased NUE compared with the wild type control.

It was further observed that increasing or generating the activity of a gene product with the activity of a "cholinephosphate cytidylyltransferase" encoded by a gene comprising the nucleic acid sequence SEQ ID NO.: 5614 in *Arabidopsis thaliana* conferred an increased biomass production compared with the wild type control.

It was further observed that increasing or generating the activity of a gene product with the activity of a "cholinephosphate cytidylyltransferase" encoded by a gene comprising the nucleic acid sequence SEQ ID NO. 5614 in *Arabidopsis thaliana* conferred an increased NUE and an increased biomass production compared with the wild type control.

In particular, it was observed that increasing or generating the activity of a gene product with the activity of a "ygr266w-protein" encoded by a gene comprising the nucleic acid sequence SEQ ID NO. 5666 in *Arabidopsis thaliana* conferred an increased yield, especially an increased NUE compared with the wild type control.

It was further observed that increasing or generating the activity of a gene product with the activity of a "ygr266w-protein" encoded by a gene comprising the nucleic acid sequence SEQ ID NO.: 5666 in *Arabidopsis thaliana* conferred an increased biomass production compared with the wild type control.

It was further observed that increasing or generating the activity of a gene product with the activity of a "ygr266w-protein" encoded by a gene comprising the nucleic acid sequence SEQ ID NO. 5666 in *Arabidopsis thaliana* conferred an increased NUE and an increased biomass production compared with the wild type control.

In particular, it was observed that increasing or generating the activity of a gene product with the activity of a "cell wall endo-beta-1,3-glucanase" encoded by a gene comprising the nucleic acid sequence SEQ ID NO. 5701 in *Arabidopsis thaliana* conferred an increased yield, especially an increased NUE compared with the wild type control.

It was further observed that increasing or generating the activity of a gene product with the activity of a "cell wall endo-beta-1,3-glucanase" encoded by a gene comprising the nucleic acid sequence SEQ ID NO.: 5701 in *Arabidopsis thaliana* conferred an increased biomass production compared with the wild type control.

It was further observed that increasing or generating the activity of a gene product with the activity of a "cell wall endo-beta-1,3-glucanase" encoded by a gene comprising the nucleic acid sequence SEQ ID NO. 5701 in *Arabidopsis thaliana* conferred an increased NUE and an increased biomass production compared with the wild type control.

In particular, it was observed that increasing or generating the activity of a gene product with the activity of a "ygr290w-protein" encoded by a gene comprising the nucleic acid sequence SEQ ID NO. 5750 in *Arabidopsis thaliana* conferred an increased yield, especially an increased NUE compared with the wild type control.

It was further observed that increasing or generating the activity of a gene product with the activity of a "ygr290w-protein" encoded by a gene comprising the nucleic acid sequence SEQ ID NO.: 5750 in *Arabidopsis thaliana* conferred an increased biomass production compared with the wild type control.

It was further observed that increasing or generating the activity of a gene product with the activity of a "ygr290w-protein" encoded by a gene comprising the nucleic acid sequence SEQ ID NO. 5750 in *Arabidopsis thaliana* conferred an increased NUE and an increased biomass production compared with the wild type control.

In particular, it was observed that increasing or generating the activity of a gene product with the activity of a "yhl021c-protein" encoded by a gene comprising the nucleic acid sequence SEQ ID NO. 5754 in *Arabidopsis thaliana* conferred an increased yield, especially an increased NUE compared with the wild type control.

It was further observed that increasing or generating the activity of a gene product with the activity of a "yhl021c-protein" encoded by a gene comprising the nucleic acid sequence SEQ ID NO.: 5754 in *Arabidopsis thaliana* conferred an increased biomass production compared with the wild type control.

It was further observed that increasing or generating the activity of a gene product with the activity of a "yhl021c-protein" encoded by a gene comprising the nucleic acid sequence SEQ ID NO. 5754 in *Arabidopsis thaliana* conferred an increased NUE and an increased biomass production compared with the wild type control.

In particular, it was observed that increasing or generating the activity of a gene product with the activity of a "v-SNARE protein involved in Golgi transport" encoded by a gene comprising the nucleic acid sequence SEQ ID NO. 5778 in *Arabidopsis thaliana* conferred an increased yield, especially an increased NUE compared with the wild type control.

It was further observed that increasing or generating the activity of a gene product with the activity of a "v-SNARE protein involved in Golgi transport" encoded by a gene comprising the nucleic acid sequence SEQ ID NO.: 5778 in *Arabidopsis thaliana* conferred an increased biomass production compared with the wild type control.

It was further observed that increasing or generating the activity of a gene product with the activity of a "v-SNARE protein involved in Golgi transport" encoded by a gene comprising the nucleic acid sequence SEQ ID NO. 5778 in *Arabidopsis thaliana* conferred an increased NUE and an increased biomass production compared with the wild type control.

In particular, it was observed that increasing or generating the activity of a gene product with the activity of a "mitochondrial seryl-tRNA synthetase" encoded by a gene comprising the nucleic acid sequence SEQ ID NO. 5812 in *Arabidopsis thaliana* conferred an increased yield, especially an increased NUE compared with the wild type control.

It was further observed that increasing or generating the activity of a gene product with the activity of a "mitochondrial seryl-tRNA synthetase" encoded by a gene comprising the nucleic acid sequence SEQ ID NO.: 5812 in *Arabidopsis thaliana* conferred an increased biomass production compared with the wild type control.

It was further observed that increasing or generating the activity of a gene product with the activity of a "mitochondrial seryl-tRNA synthetase" encoded by a gene comprising the nucleic acid sequence SEQ ID NO. 5812 in *Arabidopsis thaliana* conferred an increased NUE and an increased biomass production compared with the wild type control.

In particular, it was observed that increasing or generating the activity of a gene product with the activity of a "yhr127w-protein" encoded by a gene comprising the nucleic acid sequence SEQ ID NO. 5967 in *Arabidopsis thaliana* conferred an increased yield, especially an increased NUE compared with the wild type control.

It was further observed that increasing or generating the activity of a gene product with the activity of a "yhr127w-protein" encoded by a gene comprising the nucleic acid sequence SEQ ID NO.: 5967 in *Arabidopsis thaliana* conferred an increased biomass production compared with the wild type control.

It was further observed that increasing or generating the activity of a gene product with the activity of a "yhr127w-protein" encoded by a gene comprising the nucleic acid sequence SEQ ID NO. 5967 in *Arabidopsis thaliana* conferred an increased NUE and an increased biomass production compared with the wild type control.

In particular, it was observed that increasing or generating the activity of a gene product with the activity of a "aromatic amino acid aminotransferase II" encoded by a gene comprising the nucleic acid sequence SEQ ID NO. 5973 in *Arabidopsis thaliana* conferred an increased yield, especially an increased NUE compared with the wild type control.

It was further observed that increasing or generating the activity of a gene product with the activity of a "aromatic amino acid aminotransferase II" encoded by a gene comprising the nucleic acid sequence SEQ ID NO.: 5973 in *Arabidopsis thaliana* conferred an increased biomass production compared with the wild type control.

It was further observed that increasing or generating the activity of a gene product with the activity of a "aromatic amino acid aminotransferase II" encoded by a gene comprising the nucleic acid sequence SEQ ID NO. 5973 in *Arabidopsis thaliana* conferred an increased NUE and an increased biomass production compared with the wild type control.

In particular, it was observed that increasing or generating the activity of a gene product with the activity of a "glucoamylase" encoded by a gene comprising the nucleic acid sequence SEQ ID NO. 6027 in *Arabidopsis thaliana* conferred an increased yield, especially an increased NUE compared with the wild type control.

It was further observed that increasing or generating the activity of a gene product with the activity of a "glucoamylase" encoded by a gene comprising the nucleic acid sequence SEQ ID NO.: 6027 in *Arabidopsis thaliana* conferred an increased biomass production compared with the wild type control.

It was further observed that increasing or generating the activity of a gene product with the activity of a "glucoamylase" encoded by a gene comprising the nucleic acid sequence SEQ ID NO. 6027 in *Arabidopsis thaliana* conferred an increased NUE and an increased biomass production compared with the wild type control.

In particular, it was observed that increasing or generating the activity of a gene product with the activity of a "histidine kinase osmosensor that regulates an osmosensing MAP kinase cascade" encoded by a gene comprising the nucleic acid sequence SEQ ID NO. 6107 in *Arabidopsis thaliana* conferred an increased yield, especially an increased NUE compared with the wild type control.

It was further observed that increasing or generating the activity of a gene product with the activity of a "histidine kinase osmosensor that regulates an osmosensing MAP kinase cascade" encoded by a gene comprising the nucleic acid sequence SEQ ID NO.: 6107 in *Arabidopsis thaliana* conferred an increased biomass production compared with the wild type control.

It was further observed that increasing or generating the activity of a gene product with the activity of a "histidine kinase osmosensor that regulates an osmosensing MAP kinase cascade" encoded by a gene comprising the nucleic acid sequence SEQ ID NO. 6107 in *Arabidopsis thaliana* conferred an increased NUE and an increased biomass production compared with the wild type control.

In particular, it was observed that increasing or generating the activity of a gene product with the activity of a "saccharopine dehydrogenase" encoded by a gene comprising the nucleic acid sequence SEQ ID NO. 6150 in *Arabidopsis thaliana* conferred an increased yield, especially an increased NUE compared with the wild type control.

It was further observed that increasing or generating the activity of a gene product with the activity of a "saccharopine dehydrogenase" encoded by a gene comprising the nucleic acid sequence SEQ ID NO.: 6150 in *Arabidopsis thaliana* conferred an increased biomass production compared with the wild type control.

It was further observed that increasing or generating the activity of a gene product with the activity of a "saccharopine dehydrogenase" encoded by a gene comprising the nucleic acid sequence SEQ ID NO. 6150 in *Arabidopsis thaliana* conferred an increased NUE and an increased biomass production compared with the wild type control.

In particular, it was observed that increasing or generating the activity of a gene product with the activity of a "spindle checkpoint complex subunit" encoded by a gene comprising the nucleic acid sequence SEQ ID NO. 6198 in *Arabidopsis thaliana* conferred an increased yield, especially an increased NUE compared with the wild type control.

It was further observed that increasing or generating the activity of a gene product with the activity of a "spindle checkpoint complex subunit" encoded by a gene comprising the nucleic acid sequence SEQ ID NO.: 6198 in *Arabidopsis thaliana* conferred an increased biomass production compared with the wild type control.

It was further observed that increasing or generating the activity of a gene product with the activity of a "spindle checkpoint complex subunit" encoded by a gene comprising the nucleic acid sequence SEQ ID NO. 6198 in *Arabidopsis thaliana* conferred an increased NUE and an increased biomass production compared with the wild type control.

In particular, it was observed that increasing or generating the activity of a gene product with the activity of a "nuclear pore complex subunit" encoded by a gene comprising the nucleic acid sequence SEQ ID NO. 6208 in *Arabidopsis thaliana* conferred an increased yield, especially an increased NUE compared with the wild type control.

It was further observed that increasing or generating the activity of a gene product with the activity of a "nuclear pore complex subunit" encoded by a gene comprising the nucleic acid sequence SEQ ID NO.: 6208 in *Arabidopsis thaliana* conferred an increased biomass production compared with the wild type control.

It was further observed that increasing or generating the activity of a gene product with the activity of a "nuclear pore complex subunit" encoded by a gene comprising the nucleic acid sequence SEQ ID NO. 6208 in *Arabidopsis thaliana* conferred an increased NUE and an increased biomass production compared with the wild type control.

In particular, it was observed that increasing or generating the activity of a gene product with the activity of a "yjl064w-protein" encoded by a gene comprising the nucleic acid sequence SEQ ID NO. 6242 in *Arabidopsis thaliana* conferred an increased yield, especially an increased NUE compared with the wild type control.

It was further observed that increasing or generating the activity of a gene product with the activity of a "yjl064w-protein" encoded by a gene comprising the nucleic acid sequence SEQ ID NO.: 6242 in *Arabidopsis thaliana* conferred an increased biomass production compared with the wild type control.

It was further observed that increasing or generating the activity of a gene product with the activity of a "yjl064w-protein" encoded by a gene comprising the nucleic acid sequence SEQ ID NO. 6242 in *Arabidopsis thaliana* conferred an increased NUE and an increased biomass production compared with the wild type control.

In particular, it was observed that increasing or generating the activity of a gene product with the activity of a "yjl067w-protein" encoded by a gene comprising the nucleic acid sequence SEQ ID NO. 6246 in *Arabidopsis thaliana* conferred an increased yield, especially an increased NUE compared with the wild type control.

It was further observed that increasing or generating the activity of a gene product with the activity of a "yjl067w-protein" encoded by a gene comprising the nucleic acid sequence SEQ ID NO.: 6246 in *Arabidopsis thaliana* conferred an increased biomass production compared with the wild type control.

It was further observed that increasing or generating the activity of a gene product with the activity of a "yjl067w-protein" encoded by a gene comprising the nucleic acid sequence SEQ ID NO. 6246 in *Arabidopsis thaliana* conferred an increased NUE and an increased biomass production compared with the wild type control.

In particular, it was observed that increasing or generating the activity of a gene product with the activity of a "potassium:hydrogen antiporter" encoded by a gene comprising the nucleic acid sequence SEQ ID NO. 6250 in *Arabidopsis thaliana* conferred an increased yield, especially an increased NUE compared with the wild type control.

It was further observed that increasing or generating the activity of a gene product with the activity of a "potassium:hydrogen antiporter" encoded by a gene comprising the nucleic acid sequence SEQ ID NO.: 6250 in *Arabidopsis thaliana* conferred an increased biomass production compared with the wild type control.

It was further observed that increasing or generating the activity of a gene product with the activity of a "potassium:hydrogen antiporter" encoded by a gene comprising the nucleic acid sequence SEQ ID NO. 6250 in *Arabidopsis thaliana* conferred an increased NUE and an increased biomass production compared with the wild type control.

In particular, it was observed that increasing or generating the activity of a gene product with the activity of a "GPI-anchored cell wall protein" encoded by a gene comprising the nucleic acid sequence SEQ ID NO. 6297 in *Arabidopsis thaliana* conferred an increased yield, especially an increased NUE compared with the wild type control.

It was further observed that increasing or generating the activity of a gene product with the activity of a "GPI-anchored cell wall protein" encoded by a gene comprising the nucleic acid sequence SEQ ID NO.: 6297 in *Arabidopsis thaliana* conferred an increased biomass production compared with the wild type control.

It was further observed that increasing or generating the activity of a gene product with the activity of a "GPI-anchored cell wall protein" encoded by a gene comprising the nucleic acid sequence SEQ ID NO. 6297 in *Arabidopsis thaliana* conferred an increased NUE and an increased biomass production compared with the wild type control.

In particular, it was observed that increasing or generating the activity of a gene product with the activity of a "yjl213w-protein" encoded by a gene comprising the nucleic acid sequence SEQ ID NO. 6326 in *Arabidopsis thaliana* conferred an increased yield, especially an increased NUE compared with the wild type control.

It was further observed that increasing or generating the activity of a gene product with the activity of a "yjl213w-protein" encoded by a gene comprising the nucleic acid sequence SEQ ID NO.: 6326 in *Arabidopsis thaliana* conferred an increased biomass production compared with the wild type control.

It was further observed that increasing or generating the activity of a gene product with the activity of a "yjl213w-protein" encoded by a gene comprising the nucleic acid sequence SEQ ID NO. 6326 in *Arabidopsis thaliana* conferred an increased NUE and an increased biomass production compared with the wild type control.

In particular, it was observed that increasing or generating the activity of a gene product with the activity of a "peptidyl-prolyl cis-trans isomerase" encoded by a gene comprising the nucleic acid sequence SEQ ID NO. 6488 in *Arabidopsis thaliana* conferred an increased yield, especially an increased NUE compared with the wild type control.

It was further observed that increasing or generating the activity of a gene product with the activity of a "peptidyl-prolyl cis-trans isomerase" encoded by a gene comprising the nucleic acid sequence SEQ ID NO.: 6488 in *Arabidopsis thaliana* conferred an increased biomass production compared with the wild type control.

It was further observed that increasing or generating the activity of a gene product with the activity of a "peptidyl-prolyl cis-trans isomerase" encoded by a gene comprising the nucleic acid sequence SEQ ID NO. 6488 in *Arabidopsis thaliana* conferred an increased NUE and an increased biomass production compared with the wild type control.

In particular, it was observed that increasing or generating the activity of a gene product with the activity of a "clathrin associated protein complex small subunit" encoded by a gene comprising the nucleic acid sequence SEQ ID NO. 6550 in *Arabidopsis thaliana* conferred an increased yield, especially an increased NUE compared with the wild type control.

It was further observed that increasing or generating the activity of a gene product with the activity of a "clathrin associated protein complex small subunit" encoded by a gene comprising the nucleic acid sequence SEQ ID NO.: 6550 in *Arabidopsis thaliana* conferred an increased biomass production compared with the wild type control.

It was further observed that increasing or generating the activity of a gene product with the activity of a "clathrin associated protein complex small subunit" encoded by a gene comprising the nucleic acid sequence SEQ ID NO. 6550 in *Arabidopsis thaliana* conferred an increased NUE and an increased biomass production compared with the wild type control.

In particular, it was observed that increasing or generating the activity of a gene product with the activity of a "zinc metalloprotease" encoded by a gene comprising the nucleic acid sequence SEQ ID NO. 6700 in *Arabidopsis thaliana* conferred an increased yield, especially an increased NUE compared with the wild type control.

It was further observed that increasing or generating the activity of a gene product with the activity of a "zinc metalloprotease" encoded by a gene comprising the nucleic acid sequence SEQ ID NO.: 6700 in *Arabidopsis thaliana* conferred an increased biomass production compared with the wild type control.

It was further observed that increasing or generating the activity of a gene product with the activity of a "zinc metalloprotease" encoded by a gene comprising the nucleic acid sequence SEQ ID NO. 6700 in *Arabidopsis thaliana* conferred an increased NUE and an increased biomass production compared with the wild type control.

In particular, it was observed that increasing or generating the activity of a gene product with the activity of a "F1F0 ATP synthase beta subunit" encoded by a gene comprising the nucleic acid sequence SEQ ID NO. 6816 in *Arabidopsis thaliana* conferred an increased yield, especially an increased NUE compared with the wild type control.

It was further observed that increasing or generating the activity of a gene product with the activity of a "F1F0 ATP synthase beta subunit" encoded by a gene comprising the nucleic acid sequence SEQ ID NO.: 6816 in *Arabidopsis thaliana* conferred an increased biomass production compared with the wild type control.

It was further observed that increasing or generating the activity of a gene product with the activity of a "F1F0 ATP synthase beta subunit" encoded by a gene comprising the nucleic acid sequence SEQ ID NO. 6816 in *Arabidopsis thaliana* conferred an increased NUE and an increased biomass production compared with the wild type control.

In particular, it was observed that increasing or generating the activity of a gene product with the activity of a "alpha-mannosidase" encoded by a gene comprising the nucleic acid sequence SEQ ID NO. 7366 in *Arabidopsis thaliana* conferred an increased yield, especially an increased NUE compared with the wild type control.

It was further observed that increasing or generating the activity of a gene product with the activity of a "alpha-mannosidase" encoded by a gene comprising the nucleic acid sequence SEQ ID NO.: 7366 in *Arabidopsis thaliana* conferred an increased biomass production compared with the wild type control.

It was further observed that increasing or generating the activity of a gene product with the activity of a "alpha-mannosidase" encoded by a gene comprising the nucleic acid sequence SEQ ID NO. 7366 in *Arabidopsis thaliana* conferred an increased NUE and an increased biomass production compared with the wild type control.

In particular, it was observed that increasing or generating the activity of a gene product with the activity of a "ribosomal protein of the small subunit" encoded by a gene comprising the nucleic acid sequence SEQ ID NO. 7475 in *Arabidopsis thaliana* conferred an increased yield, especially an increased NUE compared with the wild type control.

It was further observed that increasing or generating the activity of a gene product with the activity of a "ribosomal protein of the small subunit" encoded by a gene comprising the nucleic acid sequence SEQ ID NO.: 7475 in *Arabidopsis thaliana* conferred an increased biomass production compared with the wild type control.

It was further observed that increasing or generating the activity of a gene product with the activity of a "ribosomal protein of the small subunit" encoded by a gene comprising the nucleic acid sequence SEQ ID NO. 7475 in *Arabidopsis thaliana* conferred an increased NUE and an increased biomass production compared with the wild type control.

In particular, it was observed that increasing or generating the activity of a gene product with the activity of a "mitochondrial intermembrane space protein" encoded by a gene comprising the nucleic acid sequence SEQ ID NO. 7602 in *Arabidopsis thaliana* conferred an increased yield, especially an increased NUE compared with the wild type control.

It was further observed that increasing or generating the activity of a gene product with the activity of a "mitochondrial intermembrane space protein" encoded by a gene comprising the nucleic acid sequence SEQ ID NO.: 7602 in *Arabidopsis thaliana* conferred an increased biomass production compared with the wild type control.

It was further observed that increasing or generating the activity of a gene product with the activity of a "mitochondrial intermembrane space protein" encoded by a gene comprising the nucleic acid sequence SEQ ID NO. 7602 in *Arabidopsis thaliana* conferred an increased NUE and an increased biomass production compared with the wild type control.

In particular, it was observed that increasing or generating the activity of a gene product with the activity of a "phospho-pantothenoylcysteine decarboxylase" encoded by a gene comprising the nucleic acid sequence SEQ ID NO. 7651 in *Arabidopsis thaliana* conferred an increased yield, especially an increased NUE compared with the wild type control.

It was further observed that increasing or generating the activity of a gene product with the activity of a "phosphopantothenoylcysteine decarboxylase" encoded by a gene comprising the nucleic acid sequence SEQ ID NO.: 7651 in *Arabidopsis thaliana* conferred an increased biomass production compared with the wild type control.

It was further observed that increasing or generating the activity of a gene product with the activity of a "phosphopantothenoylcysteine decarboxylase" encoded by a gene comprising the nucleic acid sequence SEQ ID NO. 7651 in *Arabidopsis thaliana* conferred an increased NUE and an increased biomass production compared with the wild type control.

In particular, it was observed that increasing or generating the activity of a gene product with the activity of a "ykl100c-protein" encoded by a gene comprising the nucleic acid sequence SEQ ID NO. 7661 in *Arabidopsis thaliana* conferred an increased yield, especially an increased NUE compared with the wild type control.

It was further observed that increasing or generating the activity of a gene product with the activity of a "ykl100c-protein" encoded by a gene comprising the nucleic acid sequence SEQ ID NO.: 7661 in *Arabidopsis thaliana* conferred an increased biomass production compared with the wild type control.

It was further observed that increasing or generating the activity of a gene product with the activity of a "ykl100c-protein" encoded by a gene comprising the nucleic acid sequence SEQ ID NO. 7661 in *Arabidopsis thaliana* conferred an increased NUE and an increased biomass production compared with the wild type control.

In particular, it was observed that increasing or generating the activity of a gene product with the activity of a "ykl131w-protein" encoded by a gene comprising the nucleic acid sequence SEQ ID NO. 7675 in *Arabidopsis thaliana* conferred an increased yield, especially an increased NUE compared with the wild type control.

It was further observed that increasing or generating the activity of a gene product with the activity of a "ykl131w-protein" encoded by a gene comprising the nucleic acid sequence SEQ ID NO.: 7675 in *Arabidopsis thaliana* conferred an increased biomass production compared with the wild type control.

It was further observed that increasing or generating the activity of a gene product with the activity of a "ykl131w-protein" encoded by a gene comprising the nucleic acid sequence SEQ ID NO. 7675 in *Arabidopsis thaliana* conferred an increased NUE and an increased biomass production compared with the wild type control.

In particular, it was observed that increasing or generating the activity of a gene product with the activity of a "mitochondrial ribosomal protein of the large subunit" encoded by a gene comprising the nucleic acid sequence SEQ ID NO. 7679 in *Arabidopsis thaliana* conferred an increased yield, especially an increased NUE compared with the wild type control.

It was further observed that increasing or generating the activity of a gene product with the activity of a "mitochondrial ribosomal protein of the large subunit" encoded by a gene comprising the nucleic acid sequence SEQ ID NO.: 7679 in *Arabidopsis thaliana* conferred an increased biomass production compared with the wild type control.

It was further observed that increasing or generating the activity of a gene product with the activity of a "mitochondrial ribosomal protein of the large subunit" encoded by a gene comprising the nucleic acid sequence SEQ ID NO. 7679 in *Arabidopsis thaliana* conferred an increased NUE and an increased biomass production compared with the wild type control.

In particular, it was observed that increasing or generating the activity of a gene product with the activity of a "G protein coupled pheromone receptor receptor" encoded by a gene comprising the nucleic acid sequence SEQ ID NO. 7710 in *Arabidopsis thaliana* conferred an increased yield, especially an increased NUE compared with the wild type control.

It was further observed that increasing or generating the activity of a gene product with the activity of a "G protein coupled pheromone receptor receptor" encoded by a gene comprising the nucleic acid sequence SEQ ID NO.: 7710 in *Arabidopsis thaliana* conferred an increased biomass production compared with the wild type control.

It was further observed that increasing or generating the activity of a gene product with the activity of a "G protein coupled pheromone receptor receptor" encoded by a gene comprising the nucleic acid sequence SEQ ID NO. 7710 in *Arabidopsis thaliana* conferred an increased NUE and an increased biomass production compared with the wild type control.

In particular, it was observed that increasing or generating the activity of a gene product with the activity of a "golgi membrane protein" encoded by a gene comprising the nucleic acid sequence SEQ ID NO. 7735 in *Arabidopsis thaliana* conferred an increased yield, especially an increased NUE compared with the wild type control.

It was further observed that increasing or generating the activity of a gene product with the activity of a "golgi membrane protein" encoded by a gene comprising the nucleic acid sequence SEQ ID NO.: 7735 in *Arabidopsis thaliana* conferred an increased biomass production compared with the wild type control.

It was further observed that increasing or generating the activity of a gene product with the activity of a "golgi membrane protein" encoded by a gene comprising the nucleic acid sequence SEQ ID NO. 7735 in *Arabidopsis thaliana* conferred an increased NUE and an increased biomass production compared with the wild type control.

In particular, it was observed that increasing or generating the activity of a gene product with the activity of a "regulatory subunit of Glc7p type 1 protein serine-threonine phosphatase" encoded by a gene comprising the nucleic acid sequence SEQ ID NO. 7778 in *Arabidopsis thaliana* conferred an increased yield, especially an increased NUE compared with the wild type control.

It was further observed that increasing or generating the activity of a gene product with the activity of a "regulatory subunit of Glc7p type 1 protein serine-threonine phosphatase" encoded by a gene comprising the nucleic acid sequence SEQ ID NO.: 7778 in *Arabidopsis thaliana* conferred an increased biomass production compared with the wild type control.

It was further observed that increasing or generating the activity of a gene product with the activity of a "regulatory subunit of Glc7p type 1 protein serine-threonine phosphatase" encoded by a gene comprising the nucleic acid sequence SEQ ID NO. 7778 in *Arabidopsis thaliana* conferred an increased NUE and an increased biomass production compared with the wild type control.

In particular, it was observed that increasing or generating the activity of a gene product with the activity of a "dihydroorotate dehydrogenase" encoded by a gene comprising the nucleic acid sequence SEQ ID NO. 7829 in *Arabidopsis thaliana* conferred an increased yield, especially an increased NUE compared with the wild type control.

It was further observed that increasing or generating the activity of a gene product with the activity of a "dihydroorotate dehydrogenase" encoded by a gene comprising the nucleic acid sequence SEQ ID NO.: 7829 in *Arabidopsis thaliana* conferred an increased biomass production compared with the wild type control.

It was further observed that increasing or generating the activity of a gene product with the activity of a "dihydroorotate dehydrogenase" encoded by a gene comprising the nucleic acid sequence SEQ ID NO. 7829 in *Arabidopsis thaliana* conferred an increased NUE and an increased biomass production compared with the wild type control.

In particular, it was observed that increasing or generating the activity of a gene product with the activity of a "ykr016w-protein" encoded by a gene comprising the nucleic acid sequence SEQ ID NO. 8017 in *Arabidopsis thaliana* conferred an increased yield, especially an increased NUE compared with the wild type control.

It was further observed that increasing or generating the activity of a gene product with the activity of a "ykr016w-protein" encoded by a gene comprising the nucleic acid sequence SEQ ID NO.: 8017 in *Arabidopsis thaliana* conferred an increased biomass production compared with the wild type control.

It was further observed that increasing or generating the activity of a gene product with the activity of a "ykr016w-protein" encoded by a gene comprising the nucleic acid sequence SEQ ID NO. 8017 in *Arabidopsis thaliana* conferred an increased NUE and an increased biomass production compared with the wild type control.

In particular, it was observed that increasing or generating the activity of a gene product with the activity of a "ykr021w-protein" encoded by a gene comprising the nucleic acid sequence SEQ ID NO. 8045 in *Arabidopsis thaliana* conferred an increased yield, especially an increased NUE compared with the wild type control.

It was further observed that increasing or generating the activity of a gene product with the activity of a "ykr021w-protein" encoded by a gene comprising the nucleic acid sequence SEQ ID NO.: 8045 in *Arabidopsis thaliana* conferred an increased biomass production compared with the wild type control.

It was further observed that increasing or generating the activity of a gene product with the activity of a "ykr021w-protein" encoded by a gene comprising the nucleic acid sequence SEQ ID NO. 8045 in *Arabidopsis thaliana* conferred an increased NUE and an increased biomass production compared with the wild type control.

In particular, it was observed that increasing or generating the activity of a gene product with the activity of a "non-essential small GTPase of the Rho/Rac subfamily of Raslike proteins" encoded by a gene comprising the nucleic acid sequence SEQ ID NO. 8073 in *Arabidopsis thaliana* conferred an increased yield, especially an increased NUE compared with the wild type control.

It was further observed that increasing or generating the activity of a gene product with the activity of a "non-essential small GTPase of the Rho/Rac subfamily of Ras-like proteins" encoded by a gene comprising the nucleic acid sequence SEQ ID NO.: 8073 in *Arabidopsis thaliana* conferred an increased biomass production compared with the wild type control.

It was further observed that increasing or generating the activity of a gene product with the activity of a "non-essential small GTPase of the Rho/Rac subfamily of Ras-like proteins" encoded by a gene comprising the nucleic acid sequence SEQ ID NO. 8073 in *Arabidopsis thaliana* conferred an increased NUE and an increased biomass production compared with the wild type control.

In particular, it was observed that increasing or generating the activity of a gene product with the activity of a "integral membrane protein localized to late Golgi vesicles" encoded by a gene comprising the nucleic acid sequence SEQ ID NO. 8263 in *Arabidopsis thaliana* conferred an increased yield, especially an increased NUE compared with the wild type control.

It was further observed that increasing or generating the activity of a gene product with the activity of a "integral membrane protein localized to late Golgi vesicles" encoded by a gene comprising the nucleic acid sequence SEQ ID NO.: 8263 in *Arabidopsis thaliana* conferred an increased biomass production compared with the wild type control.

It was further observed that increasing or generating the activity of a gene product with the activity of a "integral membrane protein localized to late Golgi vesicles" encoded by a gene comprising the nucleic acid sequence SEQ ID NO. 8263 in *Arabidopsis thaliana* conferred an increased NUE and an increased biomass production compared with the wild type control.

In particular, it was observed that increasing or generating the activity of a gene product with the activity of a "peptide transporter" encoded by a gene comprising the nucleic acid sequence SEQ ID NO. 8287 in *Arabidopsis thaliana* conferred an increased yield, especially an increased NUE compared with the wild type control.

It was further observed that increasing or generating the activity of a gene product with the activity of a "peptide transporter" encoded by a gene comprising the nucleic acid sequence SEQ ID NO.: 8287 in *Arabidopsis thaliana* conferred an increased biomass production compared with the wild type control.

It was further observed that increasing or generating the activity of a gene product with the activity of a "peptide transporter" encoded by a gene comprising the nucleic acid sequence SEQ ID NO. 8287 in *Arabidopsis thaliana* conferred an increased NUE and an increased biomass production compared with the wild type control.

In particular, it was observed that increasing or generating the activity of a gene product with the activity of a "transcription factor" encoded by a gene comprising the nucleic acid sequence SEQ ID NO. 8468 in *Arabidopsis thaliana* conferred an increased yield, especially an increased NUE compared with the wild type control.

It was further observed that increasing or generating the activity of a gene product with the activity of a "transcription factor" encoded by a gene comprising the nucleic acid sequence SEQ ID NO.: 8468 in *Arabidopsis thaliana* conferred an increased biomass production compared with the wild type control.

It was further observed that increasing or generating the activity of a gene product with the activity of a "transcription factor" encoded by a gene comprising the nucleic acid sequence SEQ ID NO. 8468 in *Arabidopsis thaliana* conferred an increased NUE and an increased biomass production compared with the wild type control.

In particular, it was observed that increasing or generating the activity of a gene product with the activity of a "transmembrane protein with a role in cell wall polymer composition" encoded by a gene comprising the nucleic acid sequence SEQ ID NO. 8484 in *Arabidopsis thaliana* conferred an increased yield, especially an increased NUE compared with the wild type control.

It was further observed that increasing or generating the activity of a gene product with the activity of a "transmembrane protein with a role in cell wall polymer composition" encoded by a gene comprising the nucleic acid sequence SEQ ID NO.: 8484 in *Arabidopsis thaliana* conferred an increased biomass production compared with the wild type control.

It was further observed that increasing or generating the activity of a gene product with the activity of a "transmembrane protein with a role in cell wall polymer composition" encoded by a gene comprising the nucleic acid sequence SEQ ID NO. 8484 in *Arabidopsis thaliana* conferred an increased NUE and an increased biomass production compared with the wild type control.

In particular, it was observed that increasing or generating the activity of a gene product with the activity of a "yll014w-protein" encoded by a gene comprising the nucleic acid sequence SEQ ID NO. 8492 in *Arabidopsis thaliana* conferred an increased yield, especially an increased NUE compared with the wild type control.

It was further observed that increasing or generating the activity of a gene product with the activity of a "yll014w-protein" encoded by a gene comprising the nucleic acid sequence SEQ ID NO.: 8492 in *Arabidopsis thaliana* conferred an increased biomass production compared with the wild type control.

It was further observed that increasing or generating the activity of a gene product with the activity of a "yll014w-protein" encoded by a gene comprising the nucleic acid sequence SEQ ID NO. 8492 in *Arabidopsis thaliana* conferred an increased NUE and an increased biomass production compared with the wild type control.

In particular, it was observed that increasing or generating the activity of a gene product with the activity of a "non-essential Ras guanine nucleotide exchange factor" encoded by a gene comprising the nucleic acid sequence SEQ ID NO. 8514 in *Arabidopsis thaliana* conferred an increased yield, especially an increased NUE compared with the wild type control.

It was further observed that increasing or generating the activity of a gene product with the activity of a "non-essential Ras guanine nucleotide exchange factor" encoded by a gene comprising the nucleic acid sequence SEQ ID NO.: 8514 in *Arabidopsis thaliana* conferred an increased biomass production compared with the wild type control.

It was further observed that increasing or generating the activity of a gene product with the activity of a "non-essential Ras guanine nucleotide exchange factor" encoded by a gene comprising the nucleic acid sequence SEQ ID NO. 8514 in *Arabidopsis thaliana* conferred an increased NUE and an increased biomass production compared with the wild type control.

In particular, it was observed that increasing or generating the activity of a gene product with the activity of a "yll023c-protein" encoded by a gene comprising the nucleic acid sequence SEQ ID NO. 8539 in *Arabidopsis thaliana* conferred an increased yield, especially an increased NUE compared with the wild type control.

It was further observed that increasing or generating the activity of a gene product with the activity of a "yll023c-protein" encoded by a gene comprising the nucleic acid sequence SEQ ID NO.: 8539 in *Arabidopsis thaliana* conferred an increased biomass production compared with the wild type control.

It was further observed that increasing or generating the activity of a gene product with the activity of a "yll023c-protein" encoded by a gene comprising the nucleic acid sequence SEQ ID NO. 8539 in *Arabidopsis thaliana* conferred an increased NUE and an increased biomass production compared with the wild type control.

In particular, it was observed that increasing or generating the activity of a gene product with the activity of a "yll037w-protein" encoded by a gene comprising the nucleic acid sequence SEQ ID NO. 8571 in *Arabidopsis thaliana* conferred an increased yield, especially an increased NUE compared with the wild type control.

It was further observed that increasing or generating the activity of a gene product with the activity of a "yll037w-protein" encoded by a gene comprising the nucleic acid sequence SEQ ID NO.: 8571 in *Arabidopsis thaliana* conferred an increased biomass production compared with the wild type control.

It was further observed that increasing or generating the activity of a gene product with the activity of a "yll037w-protein" encoded by a gene comprising the nucleic acid sequence SEQ ID NO. 8571 in *Arabidopsis thaliana* conferred an increased NUE and an increased biomass production compared with the wild type control.

In particular, it was observed that increasing or generating the activity of a gene product with the activity of a "yll049w-protein" encoded by a gene comprising the nucleic acid sequence SEQ ID NO. 8575 in *Arabidopsis thaliana* conferred an increased yield, especially an increased NUE compared with the wild type control.

It was further observed that increasing or generating the activity of a gene product with the activity of a "yll049w-protein" encoded by a gene comprising the nucleic acid sequence SEQ ID NO.: 8575 in *Arabidopsis thaliana* conferred an increased biomass production compared with the wild type control.

It was further observed that increasing or generating the activity of a gene product with the activity of a "yll049w-protein" encoded by a gene comprising the nucleic acid sequence SEQ ID NO. 8575 in *Arabidopsis thaliana* conferred an increased NUE and an increased biomass production compared with the wild type control.

In particular, it was observed that increasing or generating the activity of a gene product with the activity of a "cysteine transporter" encoded by a gene comprising the nucleic acid sequence SEQ ID NO. 8579 in *Arabidopsis thaliana* conferred an increased yield, especially an increased NUE compared with the wild type control.

It was further observed that increasing or generating the activity of a gene product with the activity of a "cysteine transporter" encoded by a gene comprising the nucleic acid sequence SEQ ID NO.: 8579 in *Arabidopsis thaliana* conferred an increased biomass production compared with the wild type control.

It was further observed that increasing or generating the activity of a gene product with the activity of a "cysteine transporter" encoded by a gene comprising the nucleic acid sequence SEQ ID NO. 8579 in *Arabidopsis thaliana* conferred an increased NUE and an increased biomass production compared with the wild type control.

In particular, it was observed that increasing or generating the activity of a gene product with the activity of a "metal ion transporter" encoded by a gene comprising the nucleic acid sequence SEQ ID NO. 8661 in *Arabidopsis thaliana* conferred an increased yield, especially an increased NUE compared with the wild type control.

It was further observed that increasing or generating the activity of a gene product with the activity of a "metal ion transporter" encoded by a gene comprising the nucleic acid sequence SEQ ID NO.: 8661 in *Arabidopsis thaliana* conferred an increased biomass production compared with the wild type control.

It was further observed that increasing or generating the activity of a gene product with the activity of a "metal ion transporter" encoded by a gene comprising the nucleic acid sequence SEQ ID NO. 8661 in *Arabidopsis thaliana* conferred an increased NUE and an increased biomass production compared with the wild type control.

In particular, it was observed that increasing or generating the activity of a gene product with the activity of a "ylr042c-protein" encoded by a gene comprising the nucleic acid sequence SEQ ID NO. 8991 in *Arabidopsis thaliana* conferred an increased yield, especially an increased NUE compared with the wild type control.

It was further observed that increasing or generating the activity of a gene product with the activity of a "ylr042c-protein" encoded by a gene comprising the nucleic acid sequence SEQ ID NO.: 8991 in *Arabidopsis thaliana* conferred an increased biomass production compared with the wild type control.

It was further observed that increasing or generating the activity of a gene product with the activity of a "ylr042c-protein" encoded by a gene comprising the nucleic acid sequence SEQ ID NO. 8991 in *Arabidopsis thaliana* conferred an increased NUE and an increased biomass production compared with the wild type control.

In particular, it was observed that increasing or generating the activity of a gene product with the activity of a "YLR053C-protein" encoded by a gene comprising the nucleic acid sequence SEQ ID NO. 8995 in *Arabidopsis thaliana* conferred an increased yield, especially an increased NUE compared with the wild type control.

It was further observed that increasing or generating the activity of a gene product with the activity of a "YLR053c-protein" encoded by a gene comprising the nucleic acid sequence SEQ ID NO.: 8995 in *Arabidopsis thaliana* conferred an increased biomass production compared with the wild type control.

It was further observed that increasing or generating the activity of a gene product with the activity of a "YLR053c-protein" encoded by a gene comprising the nucleic acid sequence SEQ ID NO. 8995 in *Arabidopsis thaliana* conferred an increased NUE and an increased biomass production compared with the wild type control.

In particular, it was observed that increasing or generating the activity of a gene product with the activity of a "cytosolic serine hydroxymethyltransferase" encoded by a gene comprising the nucleic acid sequence SEQ ID NO. 8999 in *Arabidopsis thaliana* conferred an increased yield, especially an increased NUE compared with the wild type control.

It was further observed that increasing or generating the activity of a gene product with the activity of a "cytosolic serine hydroxymethyltransferase" encoded by a gene comprising the nucleic acid sequence SEQ ID NO.: 8999 in *Arabidopsis thaliana* conferred an increased biomass production compared with the wild type control.

It was further observed that increasing or generating the activity of a gene product with the activity of a "cytosolic serine hydroxymethyltransferase" encoded by a gene comprising the nucleic acid sequence SEQ ID NO. 8999 in *Arabidopsis thaliana* conferred an increased NUE and an increased biomass production compared with the wild type control.

In particular, it was observed that increasing or generating the activity of a gene product with the activity of a "subunit of cytoplasmic phenylalanyl-tRNA synthetase" encoded by a gene comprising the nucleic acid sequence SEQ ID NO. 9551 in *Arabidopsis thaliana* conferred an increased yield, especially an increased NUE compared with the wild type control.

It was further observed that increasing or generating the activity of a gene product with the activity of a "subunit of cytoplasmic phenylalanyl-tRNA synthetase" encoded by a gene comprising the nucleic acid sequence SEQ ID NO.: 9551 in *Arabidopsis thaliana* conferred an increased biomass production compared with the wild type control.

It was further observed that increasing or generating the activity of a gene product with the activity of a "subunit of cytoplasmic phenylalanyl-tRNA synthetase" encoded by a gene comprising the nucleic acid sequence SEQ ID NO. 9551 in *Arabidopsis thaliana* conferred an increased NUE and an increased biomass production compared with the wild type control.

In particular, it was observed that increasing or generating the activity of a gene product with the activity of a "ylr065c-protein" encoded by a gene comprising the nucleic acid sequence SEQ ID NO. 9637 in *Arabidopsis thaliana* conferred an increased yield, especially an increased NUE compared with the wild type control.

It was further observed that increasing or generating the activity of a gene product with the activity of a "ylr065c-protein" encoded by a gene comprising the nucleic acid sequence SEQ ID NO.: 9637 in *Arabidopsis thaliana* conferred an increased biomass production compared with the wild type control.

It was further observed that increasing or generating the activity of a gene product with the activity of a "ylr065c-protein" encoded by a gene comprising the nucleic acid sequence SEQ ID NO. 9637 in *Arabidopsis thaliana* conferred an increased NUE and an increased biomass production compared with the wild type control.

In particular, it was observed that increasing or generating the activity of a gene product with the activity of a "xylitol dehydrogenase" encoded by a gene comprising the nucleic acid sequence SEQ ID NO. 9672 in *Arabidopsis thaliana* conferred an increased yield, especially an increased NUE compared with the wild type control.

It was further observed that increasing or generating the activity of a gene product with the activity of a "xylitol dehydrogenase" encoded by a gene comprising the nucleic acid sequence SEQ ID NO.: 9672 in *Arabidopsis thaliana* conferred an increased biomass production compared with the wild type control.

It was further observed that increasing or generating the activity of a gene product with the activity of a "xylitol dehydrogenase" encoded by a gene comprising the nucleic acid sequence SEQ ID NO. 9672 in *Arabidopsis thaliana* conferred an increased NUE and an increased biomass production compared with the wild type control.

In particular, it was observed that increasing or generating the activity of a gene product with the activity of a "3-keto sterol reductase" encoded by a gene comprising the nucleic acid sequence SEQ ID NO. 10182 in *Arabidopsis thaliana* conferred an increased yield, especially an increased NUE compared with the wild type control.

It was further observed that increasing or generating the activity of a gene product with the activity of a "3-keto sterol reductase" encoded by a gene comprising the nucleic acid sequence SEQ ID NO.: 10182 in *Arabidopsis thaliana* conferred an increased biomass production compared with the wild type control.

It was further observed that increasing or generating the activity of a gene product with the activity of a "3-keto sterol reductase" encoded by a gene comprising the nucleic acid sequence SEQ ID NO. 10182 in *Arabidopsis thaliana* conferred an increased NUE and an increased biomass production compared with the wild type control.

In particular, it was observed that increasing or generating the activity of a gene product with the activity of a "alkyl hydroperoxide reductase" encoded by a gene comprising the nucleic acid sequence SEQ ID NO. 10214 in *Arabidopsis thaliana* conferred an increased yield, especially an increased NUE compared with the wild type control.

It was further observed that increasing or generating the activity of a gene product with the activity of a "alkyl hydroperoxide reductase" encoded by a gene comprising the nucleic acid sequence SEQ ID NO.: 10214 in *Arabidopsis thaliana* conferred an increased biomass production compared with the wild type control.

It was further observed that increasing or generating the activity of a gene product with the activity of a "alkyl hydroperoxide reductase" encoded by a gene comprising the nucleic acid sequence SEQ ID NO. 10214 in *Arabidopsis thaliana* conferred an increased NUE and an increased biomass production compared with the wild type control.

In particular, it was observed that increasing or generating the activity of a gene product with the activity of a "ylr125w-protein" encoded by a gene comprising the nucleic acid sequence SEQ ID NO. 10447 in *Arabidopsis thaliana* conferred an increased yield, especially an increased NUE compared with the wild type control.

It was further observed that increasing or generating the activity of a gene product with the activity of a "ylr125w-protein" encoded by a gene comprising the nucleic acid sequence SEQ ID NO.: 10447 in *Arabidopsis thaliana* conferred an increased biomass production compared with the wild type control.

It was further observed that increasing or generating the activity of a gene product with the activity of a "ylr125w-protein" encoded by a gene comprising the nucleic acid sequence SEQ ID NO. 10447 in *Arabidopsis thaliana* conferred an increased NUE and an increased biomass production compared with the wild type control.

In particular, it was observed that increasing or generating the activity of a gene product with the activity of a "anaphase promoting complex (APC) subunit" encoded by a gene comprising the nucleic acid sequence SEQ ID NO. 10451 in *Arabidopsis thaliana* conferred an increased yield, especially an increased NUE compared with the wild type control.

It was further observed that increasing or generating the activity of a gene product with the activity of a "anaphase promoting complex (APC) subunit" encoded by a gene comprising the nucleic acid sequence SEQ ID NO.: 10451 in *Arabidopsis thaliana* conferred an increased biomass production compared with the wild type control.

It was further observed that increasing or generating the activity of a gene product with the activity of a "anaphase promoting complex (APC) subunit" encoded by a gene comprising the nucleic acid sequence SEQ ID NO. 10451 in *Arabidopsis thaliana* conferred an increased NUE and an increased biomass production compared with the wild type control.

In particular, it was observed that increasing or generating the activity of a gene product with the activity of a "protein component of the large ribosomal subunit" encoded by a gene comprising the nucleic acid sequence SEQ ID NO. 10463 in *Arabidopsis thaliana* conferred an increased yield, especially an increased NUE compared with the wild type control.

It was further observed that increasing or generating the activity of a gene product with the activity of a "protein component of the large ribosomal subunit" encoded by a gene comprising the nucleic acid sequence SEQ ID NO.: 10463 in *Arabidopsis thaliana* conferred an increased biomass production compared with the wild type control.

It was further observed that increasing or generating the activity of a gene product with the activity of a "protein component of the large ribosomal subunit" encoded by a gene comprising the nucleic acid sequence SEQ ID NO. 10463 in *Arabidopsis thaliana* conferred an increased NUE and an increased biomass production compared with the wild type control.

In particular, it was observed that increasing or generating the activity of a gene product with the activity of a "mitochondrial protein" encoded by a gene comprising the nucleic acid sequence SEQ ID NO. 10533 in *Arabidopsis thaliana* conferred an increased yield, especially an increased NUE compared with the wild type control.

It was further observed that increasing or generating the activity of a gene product with the activity of a "mitochondrial protein" encoded by a gene comprising the nucleic acid sequence SEQ ID NO.: 10533 in *Arabidopsis thaliana* conferred an increased biomass production compared with the wild type control.

It was further observed that increasing or generating the activity of a gene product with the activity of a "mitochondrial protein" encoded by a gene comprising the nucleic acid sequence SEQ ID NO. 10533 in *Arabidopsis thaliana* conferred an increased NUE and an increased biomass production compared with the wild type control.

In particular, it was observed that increasing or generating the activity of a gene product with the activity of a "ARV1 protein" encoded by a gene comprising the nucleic acid sequence SEQ ID NO. 10541 in *Arabidopsis thaliana* conferred an increased yield, especially an increased NUE compared with the wild type control.

It was further observed that increasing or generating the activity of a gene product with the activity of a "ARV1 protein" encoded by a gene comprising the nucleic acid sequence SEQ ID NO.: 10541 in *Arabidopsis thaliana* conferred an increased biomass production compared with the wild type control.

It was further observed that increasing or generating the activity of a gene product with the activity of a "ARV1 protein" encoded by a gene comprising the nucleic acid sequence SEQ ID NO. 10541 in *Arabidopsis thaliana* conferred an increased NUE and an increased biomass production compared with the wild type control.

In particular, it was observed that increasing or generating the activity of a gene product with the activity of a "GTP-binding protein" encoded by a gene comprising the nucleic acid sequence SEQ ID NO. 10562 in *Arabidopsis thaliana* conferred an increased yield, especially an increased NUE compared with the wild type control.

It was further observed that increasing or generating the activity of a gene product with the activity of a "GTP-binding protein" encoded by a gene comprising the nucleic acid sequence SEQ ID NO.: 10562 in *Arabidopsis thaliana* conferred an increased biomass production compared with the wild type control.

It was further observed that increasing or generating the activity of a gene product with the activity of a "GTP-binding protein" encoded by a gene comprising the nucleic acid sequence SEQ ID NO. 10562 in *Arabidopsis thaliana* conferred an increased NUE and an increased biomass production compared with the wild type control.

In particular, it was observed that increasing or generating the activity of a gene product with the activity of a "protein involved in shmoo formation and bipolar bud site selection"

encoded by a gene comprising the nucleic acid sequence SEQ ID NO. 10990 in *Arabidopsis thaliana* conferred an increased yield, especially an increased NUE compared with the wild type control.

It was further observed that increasing or generating the activity of a gene product with the activity of a "protein involved in shmoo formation and bipolar bud site selection" encoded by a gene comprising the nucleic acid sequence SEQ ID NO.: 10990 in *Arabidopsis thaliana* conferred an increased biomass production compared with the wild type control.

It was further observed that increasing or generating the activity of a gene product with the activity of a "protein involved in shmoo formation and bipolar bud site selection" encoded by a gene comprising the nucleic acid sequence SEQ ID NO. 10990 in *Arabidopsis thaliana* conferred an increased NUE and an increased biomass production compared with the wild type control.

In particular, it was observed that increasing or generating the activity of a gene product with the activity of a "non-essential kinetochore protein" encoded by a gene comprising the nucleic acid sequence SEQ ID NO. 10998 in *Arabidopsis thaliana* conferred an increased yield, especially an increased NUE compared with the wild type control.

It was further observed that increasing or generating the activity of a gene product with the activity of a "non-essential kinetochore protein" encoded by a gene comprising the nucleic acid sequence SEQ ID NO.: 10998 in *Arabidopsis thaliana* conferred an increased biomass production compared with the wild type control.

It was further observed that increasing or generating the activity of a gene product with the activity of a "non-essential kinetochore protein" encoded by a gene comprising the nucleic acid sequence SEQ ID NO. 10998 in *Arabidopsis thaliana* conferred an increased NUE and an increased biomass production compared with the wild type control.

In particular, it was observed that increasing or generating the activity of a gene product with the activity of a "Meiotic recombination protein" encoded by a gene comprising the nucleic acid sequence SEQ ID NO. 11004 in *Arabidopsis thaliana* conferred an increased yield, especially an increased NUE compared with the wild type control.

It was further observed that increasing or generating the activity of a gene product with the activity of a "Meiotic recombination protein" encoded by a gene comprising the nucleic acid sequence SEQ ID NO.: 11004 in *Arabidopsis thaliana* conferred an increased biomass production compared with the wild type control.

It was further observed that increasing or generating the activity of a gene product with the activity of a "Meiotic recombination protein" encoded by a gene comprising the nucleic acid sequence SEQ ID NO. 11004 in *Arabidopsis thaliana* conferred an increased NUE and an increased biomass production compared with the wild type control.

In particular, it was observed that increasing or generating the activity of a gene product with the activity of a "signal transducing MEK kinase" encoded by a gene comprising the nucleic acid sequence SEQ ID NO. 11012 in *Arabidopsis thaliana* conferred an increased yield, especially an increased NUE compared with the wild type control.

It was further observed that increasing or generating the activity of a gene product with the activity of a "signal transducing MEK kinase" encoded by a gene comprising the nucleic acid sequence SEQ ID NO.: 11012 in *Arabidopsis thaliana* conferred an increased biomass production compared with the wild type control.

It was further observed that increasing or generating the activity of a gene product with the activity of a "signal transducing MEK kinase" encoded by a gene comprising the nucleic acid sequence SEQ ID NO. 11012 in *Arabidopsis thaliana* conferred an increased NUE and an increased biomass production compared with the wild type control.

In particular, it was observed that increasing or generating the activity of a gene product with the activity of a "cytochrome c oxidase subunit VIII" encoded by a gene comprising the nucleic acid sequence SEQ ID NO. 11054 in *Arabidopsis thaliana* conferred an increased yield, especially an increased NUE compared with the wild type control.

It was further observed that increasing or generating the activity of a gene product with the activity of a "cytochrome c oxidase subunit VIII" encoded by a gene comprising the nucleic acid sequence SEQ ID NO.: 11054 in *Arabidopsis thaliana* conferred an increased biomass production compared with the wild type control.

It was further observed that increasing or generating the activity of a gene product with the activity of a "cytochrome c oxidase subunit VIII" encoded by a gene comprising the nucleic acid sequence SEQ ID NO. 11054 in *Arabidopsis thaliana* conferred an increased NUE and an increased biomass production compared with the wild type control.

In particular, it was observed that increasing or generating the activity of a gene product with the activity of a "ylr404w-protein" encoded by a gene comprising the nucleic acid sequence SEQ ID NO. 11066 in *Arabidopsis thaliana* conferred an increased yield, especially an increased NUE compared with the wild type control.

It was further observed that increasing or generating the activity of a gene product with the activity of a "ylr404w-protein" encoded by a gene comprising the nucleic acid sequence SEQ ID NO.: 11066 in *Arabidopsis thaliana* conferred an increased biomass production compared with the wild type control.

It was further observed that increasing or generating the activity of a gene product with the activity of a "ylr404w-protein" encoded by a gene comprising the nucleic acid sequence SEQ ID NO. 11066 in *Arabidopsis thaliana* conferred an increased NUE and an increased biomass production compared with the wild type control.

In particular, it was observed that increasing or generating the activity of a gene product with the activity of a "ylr463c-protein" encoded by a gene comprising the nucleic acid sequence SEQ ID NO. 11074 in *Arabidopsis thaliana* conferred an increased yield, especially an increased NUE compared with the wild type control.

It was further observed that increasing or generating the activity of a gene product with the activity of a "ylr463c-protein" encoded by a gene comprising the nucleic acid sequence SEQ ID NO.: 11074 in *Arabidopsis thaliana* conferred an increased biomass production compared with the wild type control.

It was further observed that increasing or generating the activity of a gene product with the activity of a "ylr463c-protein" encoded by a gene comprising the nucleic acid sequence SEQ ID NO. 11074 in *Arabidopsis thaliana* conferred an increased NUE and an increased biomass production compared with the wild type control.

In particular, it was observed that increasing or generating the activity of a gene product with the activity of a "adenine phosphoribosyltransferase" encoded by a gene comprising the nucleic acid sequence SEQ ID NO. 11080 in *Arabidopsis thaliana* conferred an increased yield, especially an increased NUE compared with the wild type control.

It was further observed that increasing or generating the activity of a gene product with the activity of a "adenine phosphoribosyltransferase" encoded by a gene comprising the nucleic acid sequence SEQ ID NO.: 11080 in *Arabidopsis thaliana* conferred an increased biomass production compared with the wild type control.

It was further observed that increasing or generating the activity of a gene product with the activity of a "adenine phosphoribosyltransferase" encoded by a gene comprising the nucleic acid sequence SEQ ID NO. 11080 in *Arabidopsis thaliana* conferred an increased NUE and an increased biomass production compared with the wild type control.

In particular, it was observed that increasing or generating the activity of a gene product with the activity of a "Mcm1p binding transcriptional repressor" encoded by a gene comprising the nucleic acid sequence SEQ ID NO. 11552 in *Arabidopsis thaliana* conferred an increased yield, especially an increased NUE compared with the wild type control.

It was further observed that increasing or generating the activity of a gene product with the activity of a "Mcm1p binding transcriptional repressor" encoded by a gene comprising the nucleic acid sequence SEQ ID NO.: 11552 in *Arabidopsis thaliana* conferred an increased biomass production compared with the wild type control.

It was further observed that increasing or generating the activity of a gene product with the activity of a "Mcm1p binding transcriptional repressor" encoded by a gene comprising the nucleic acid sequence SEQ ID NO. 11552 in *Arabidopsis thaliana* conferred an increased NUE and an increased biomass production compared with the wild type control.

In particular, it was observed that increasing or generating the activity of a gene product with the activity of a "origin recognition complex subunit" encoded by a gene comprising the nucleic acid sequence SEQ ID NO. 11569 in *Arabidopsis thaliana* conferred an increased yield, especially an increased NUE compared with the wild type control.

It was further observed that increasing or generating the activity of a gene product with the activity of a "origin recognition complex subunit" encoded by a gene comprising the nucleic acid sequence SEQ ID NO.: 11569 in *Arabidopsis thaliana* conferred an increased biomass production compared with the wild type control.

It was further observed that increasing or generating the activity of a gene product with the activity of a "origin recognition complex subunit" encoded by a gene comprising the nucleic acid sequence SEQ ID NO. 11569 in *Arabidopsis thaliana* conferred an increased NUE and an increased biomass production compared with the wild type control.

In particular, it was observed that increasing or generating the activity of a gene product with the activity of a "yml089c-protein" encoded by a gene comprising the nucleic acid sequence SEQ ID NO. 11596 in *Arabidopsis thaliana* conferred an increased yield, especially an increased NUE compared with the wild type control.

It was further observed that increasing or generating the activity of a gene product with the activity of a "yml089c-protein" encoded by a gene comprising the nucleic acid sequence SEQ ID NO.: 11596 in *Arabidopsis thaliana* conferred an increased biomass production compared with the wild type control.

It was further observed that increasing or generating the activity of a gene product with the activity of a "yml089c-protein" encoded by a gene comprising the nucleic acid sequence SEQ ID NO. 11596 in *Arabidopsis thaliana* conferred an increased NUE and an increased biomass production compared with the wild type control.

In particular, it was observed that increasing or generating the activity of a gene product with the activity of a "yml128c-protein" encoded by a gene comprising the nucleic acid sequence SEQ ID NO. 11600 in *Arabidopsis thaliana* conferred an increased yield, especially an increased NUE compared with the wild type control.

It was further observed that increasing or generating the activity of a gene product with the activity of a "yml128c-protein" encoded by a gene comprising the nucleic acid sequence SEQ ID NO.: 11600 in *Arabidopsis thaliana* conferred an increased biomass production compared with the wild type control.

It was further observed that increasing or generating the activity of a gene product with the activity of a "yml128c-protein" encoded by a gene comprising the nucleic acid sequence SEQ ID NO. 11600 in *Arabidopsis thaliana* conferred an increased NUE and an increased biomass production compared with the wild type control.

In particular, it was observed that increasing or generating the activity of a gene product with the activity of a "hexose transporter" encoded by a gene comprising the nucleic acid sequence SEQ ID NO. 11612 in *Arabidopsis thaliana* conferred an increased yield, especially an increased NUE compared with the wild type control.

It was further observed that increasing or generating the activity of a gene product with the activity of a "hexose transporter" encoded by a gene comprising the nucleic acid sequence SEQ ID NO.: 11612 in *Arabidopsis thaliana* conferred an increased biomass production compared with the wild type control.

It was further observed that increasing or generating the activity of a gene product with the activity of a "hexose transporter" encoded by a gene comprising the nucleic acid sequence SEQ ID NO. 11612 in *Arabidopsis thaliana* conferred an increased NUE and an increased biomass production compared with the wild type control.

In particular, it was observed that increasing or generating the activity of a gene product with the activity of a "Zinc finger protein" encoded by a gene comprising the nucleic acid sequence SEQ ID NO. 12246 in *Arabidopsis thaliana* conferred an increased yield, especially an increased NUE compared with the wild type control.

It was further observed that increasing or generating the activity of a gene product with the activity of a "Zinc finger protein" encoded by a gene comprising the nucleic acid sequence SEQ ID NO.: 12246 in *Arabidopsis thaliana* conferred an increased biomass production compared with the wild type control.

It was further observed that increasing or generating the activity of a gene product with the activity of a "Zinc finger protein" encoded by a gene comprising the nucleic acid sequence SEQ ID NO. 12246 in *Arabidopsis thaliana* conferred an increased NUE and an increased biomass production compared with the wild type control.

In particular, it was observed that increasing or generating the activity of a gene product with the activity of a "protein required for maturation of ribosomal RNAs" encoded by a gene comprising the nucleic acid sequence SEQ ID NO. 12263 in *Arabidopsis thaliana* conferred an increased yield, especially an increased NUE compared with the wild type control.

It was further observed that increasing or generating the activity of a gene product with the activity of a "protein required for maturation of ribosomal RNAs" encoded by a gene comprising the nucleic acid sequence SEQ ID NO.: 12263 in *Arabidopsis thaliana* conferred an increased biomass production compared with the wild type control.

It was further observed that increasing or generating the activity of a gene product with the activity of a "protein required for maturation of ribosomal RNAs" encoded by a gene comprising the nucleic acid sequence SEQ ID NO. 12263 in *Arabidopsis thaliana* conferred an increased NUE and an increased biomass production compared with the wild type control.

In particular, it was observed that increasing or generating the activity of a gene product with the activity of a "Factor arrest protein" encoded by a gene comprising the nucleic acid sequence SEQ ID NO. 12316 in *Arabidopsis thaliana* conferred an increased yield, especially an increased NUE compared with the wild type control.

It was further observed that increasing or generating the activity of a gene product with the activity of a "Factor arrest protein" encoded by a gene comprising the nucleic acid sequence SEQ ID NO.: 12316 in *Arabidopsis thaliana* conferred an increased biomass production compared with the wild type control.

It was further observed that increasing or generating the activity of a gene product with the activity of a "Factor arrest protein" encoded by a gene comprising the nucleic acid sequence SEQ ID NO. 12316 in *Arabidopsis thaliana* conferred an increased NUE and an increased biomass production compared with the wild type control.

In particular, it was observed that increasing or generating the activity of a gene product with the activity of a "YMR082C-protein" encoded by a gene comprising the nucleic acid sequence SEQ ID NO. 12327 in *Arabidopsis thaliana* conferred an increased yield, especially an increased NUE compared with the wild type control.

It was further observed that increasing or generating the activity of a gene product with the activity of a "YMR082C-protein" encoded by a gene comprising the nucleic acid sequence SEQ ID NO.: 12327 in *Arabidopsis thaliana* conferred an increased biomass production compared with the wild type control.

It was further observed that increasing or generating the activity of a gene product with the activity of a "YMR082C-protein" encoded by a gene comprising the nucleic acid sequence SEQ ID NO. 12327 in *Arabidopsis thaliana* conferred an increased NUE and an increased biomass production compared with the wild type control.

In particular, it was observed that increasing or generating the activity of a gene product with the activity of a "Nuclear cap-binding protein complex subunit" encoded by a gene comprising the nucleic acid sequence SEQ ID NO. 12331 in *Arabidopsis thaliana* conferred an increased yield, especially an increased NUE compared with the wild type control.

It was further observed that increasing or generating the activity of a gene product with the activity of a "Nuclear cap-binding protein complex subunit" encoded by a gene comprising the nucleic acid sequence SEQ ID NO.: 12331 in *Arabidopsis thaliana* conferred an increased biomass production compared with the wild type control.

It was further observed that increasing or generating the activity of a gene product with the activity of a "Nuclear cap-binding protein complex subunit" encoded by a gene comprising the nucleic acid sequence SEQ ID NO. 12331 in *Arabidopsis thaliana* conferred an increased NUE and an increased biomass production compared with the wild type control.

In particular, it was observed that increasing or generating the activity of a gene product with the activity of a "YMR126C membrane protein" encoded by a gene comprising the nucleic acid sequence SEQ ID NO. 12378 in *Arabidopsis thaliana* conferred an increased yield, especially an increased NUE compared with the wild type control.

It was further observed that increasing or generating the activity of a gene product with the activity of a "YMR126C membrane protein" encoded by a gene comprising the nucleic acid sequence SEQ ID NO.: 12378 in *Arabidopsis thaliana* conferred an increased biomass production compared with the wild type control.

It was further observed that increasing or generating the activity of a gene product with the activity of a "YMR126C membrane protein" encoded by a gene comprising the nucleic acid sequence SEQ ID NO. 12378 in *Arabidopsis thaliana* conferred an increased NUE and an increased biomass production compared with the wild type control.

In particular, it was observed that increasing or generating the activity of a gene product with the activity of a "YMR144W-protein" encoded by a gene comprising the nucleic acid sequence SEQ ID NO. 12394 in *Arabidopsis thaliana* conferred an increased yield, especially an increased NUE compared with the wild type control.

It was further observed that increasing or generating the activity of a gene product with the activity of a "YMR144W-protein" encoded by a gene comprising the nucleic acid sequence SEQ ID NO.: 12394 in *Arabidopsis thaliana* conferred an increased biomass production compared with the wild type control.

It was further observed that increasing or generating the activity of a gene product with the activity of a "YMR144W-protein" encoded by a gene comprising the nucleic acid sequence SEQ ID NO. 12394 in *Arabidopsis thaliana* conferred an increased NUE and an increased biomass production compared with the wild type control.

In particular, it was observed that increasing or generating the activity of a gene product with the activity of a "YMR160W-protein" encoded by a gene comprising the nucleic acid sequence SEQ ID NO. 12406 in *Arabidopsis thaliana* conferred an increased yield, especially an increased NUE compared with the wild type control.

It was further observed that increasing or generating the activity of a gene product with the activity of a "YMR160W-protein" encoded by a gene comprising the nucleic acid sequence SEQ ID NO.: 12406 in *Arabidopsis thaliana* conferred an increased biomass production compared with the wild type control.

It was further observed that increasing or generating the activity of a gene product with the activity of a "YMR160W-protein" encoded by a gene comprising the nucleic acid sequence SEQ ID NO. 12406 in *Arabidopsis thaliana* conferred an increased NUE and an increased biomass production compared with the wild type control.

In particular, it was observed that increasing or generating the activity of a gene product with the activity of a "Stationary phase protein" encoded by a gene comprising the nucleic acid sequence SEQ ID NO. 12414 in *Arabidopsis thaliana* conferred an increased yield, especially an increased NUE compared with the wild type control.

It was further observed that increasing or generating the activity of a gene product with the activity of a "Stationary phase protein" encoded by a gene comprising the nucleic acid sequence SEQ ID NO.: 12414 in *Arabidopsis thaliana* conferred an increased biomass production compared with the wild type control.

It was further observed that increasing or generating the activity of a gene product with the activity of a "Stationary phase protein" encoded by a gene comprising the nucleic acid sequence SEQ ID NO. 12414 in *Arabidopsis thaliana* conferred an increased NUE and an increased biomass production compared with the wild type control.

In particular, it was observed that increasing or generating the activity of a gene product with the activity of a "YMR209C-protein" encoded by a gene comprising the nucleic acid sequence SEQ ID NO. 12420 in *Arabidopsis thaliana* conferred an increased yield, especially an increased NUE compared with the wild type control.

It was further observed that increasing or generating the activity of a gene product with the activity of a "YMR209C-protein" encoded by a gene comprising the nucleic acid sequence SEQ ID NO.: 12420 in *Arabidopsis thaliana* conferred an increased biomass production compared with the wild type control.

It was further observed that increasing or generating the activity of a gene product with the activity of a "YMR209C-protein" encoded by a gene comprising the nucleic acid sequence SEQ ID NO. 12420 in *Arabidopsis thaliana* conferred an increased NUE and an increased biomass production compared with the wild type control.

In particular, it was observed that increasing or generating the activity of a gene product with the activity of a "YMR233W-protein" encoded by a gene comprising the nucleic acid sequence SEQ ID NO. 12440 in *Arabidopsis thaliana* conferred an increased yield, especially an increased NUE compared with the wild type control.

It was further observed that increasing or generating the activity of a gene product with the activity of a "YMR233W-protein" encoded by a gene comprising the nucleic acid sequence SEQ ID NO.: 12440 in *Arabidopsis thaliana* conferred an increased biomass production compared with the wild type control.

It was further observed that increasing or generating the activity of a gene product with the activity of a "YMR233W-protein" encoded by a gene comprising the nucleic acid sequence SEQ ID NO. 12440 in *Arabidopsis thaliana* conferred an increased NUE and an increased biomass production compared with the wild type control.

In particular, it was observed that increasing or generating the activity of a gene product with the activity of a "phosphoglucomutase/phosphomannomutase" encoded by a gene comprising the nucleic acid sequence SEQ ID NO. 12470 in *Arabidopsis thaliana* conferred an increased yield, especially an increased NUE compared with the wild type control.

It was further observed that increasing or generating the activity of a gene product with the activity of a "phosphoglucomutase/phosphomannomutase" encoded by a gene comprising the nucleic acid sequence SEQ ID NO.: 12470 in *Arabidopsis thaliana* conferred an increased biomass production compared with the wild type control.

It was further observed that increasing or generating the activity of a gene product with the activity of a "phosphoglucomutase/phosphomannomutase" encoded by a gene comprising the nucleic acid sequence SEQ ID NO. 12470 in *Arabidopsis thaliana* conferred an increased NUE and an increased biomass production compared with the wild type control.

In particular, it was observed that increasing or generating the activity of a gene product with the activity of a "Regulatory CAT8 protein" encoded by a gene comprising the nucleic acid sequence SEQ ID NO. 12749 in *Arabidopsis thaliana* conferred an increased yield, especially an increased NUE compared with the wild type control.

It was further observed that increasing or generating the activity of a gene product with the activity of a "Regulatory CAT8 protein" encoded by a gene comprising the nucleic acid sequence SEQ ID NO.: 12749 in *Arabidopsis thaliana* conferred an increased biomass production compared with the wild type control.

It was further observed that increasing or generating the activity of a gene product with the activity of a "Regulatory CAT8 protein" encoded by a gene comprising the nucleic acid sequence SEQ ID NO. 12749 in *Arabidopsis thaliana* conferred an increased NUE and an increased biomass production compared with the wild type control.

In particular, it was observed that increasing or generating the activity of a gene product with the activity of a "translational elongation factor EF-3 (HEF3)" encoded by a gene comprising the nucleic acid sequence SEQ ID NO. 12773 in *Arabidopsis thaliana* conferred an increased yield, especially an increased NUE compared with the wild type control.

It was further observed that increasing or generating the activity of a gene product with the activity of a "translational elongation factor EF-3 (HEF3)" encoded by a gene comprising the nucleic acid sequence SEQ ID NO.: 12773 in *Arabidopsis thaliana* conferred an increased biomass production compared with the wild type control.

It was further observed that increasing or generating the activity of a gene product with the activity of a "translational elongation factor EF-3 (HEF3)" encoded by a gene comprising the nucleic acid sequence SEQ ID NO. 12773 in *Arabidopsis thaliana* conferred an increased NUE and an increased biomass production compared with the wild type control.

In particular, it was observed that increasing or generating the activity of a gene product with the activity of a "YNL320W-protein" encoded by a gene comprising the nucleic acid sequence SEQ ID NO. 12829 in *Arabidopsis thaliana* conferred an increased yield, especially an increased NUE compared with the wild type control.

It was further observed that increasing or generating the activity of a gene product with the activity of a "YNL320W-protein" encoded by a gene comprising the nucleic acid sequence SEQ ID NO.: 12829 in *Arabidopsis thaliana* conferred an increased biomass production compared with the wild type control.

It was further observed that increasing or generating the activity of a gene product with the activity of a "YNL320W-protein" encoded by a gene comprising the nucleic acid sequence SEQ ID NO. 12829 in *Arabidopsis thaliana* conferred an increased NUE and an increased biomass production compared with the wild type control.

In particular, it was observed that increasing or generating the activity of a gene product with the activity of a "Chitin synthase 3 complex protein" encoded by a gene comprising the nucleic acid sequence SEQ ID NO. 12883 in *Arabidopsis thaliana* conferred an increased yield, especially an increased NUE compared with the wild type control.

It was further observed that increasing or generating the activity of a gene product with the activity of a "Chitin synthase 3 complex protein" encoded by a gene comprising the nucleic acid sequence SEQ ID NO.: 12883 in *Arabidopsis thaliana* conferred an increased biomass production compared with the wild type control.

It was further observed that increasing or generating the activity of a gene product with the activity of a "Chitin synthase 3 complex protein" encoded by a gene comprising the nucleic acid sequence SEQ ID NO. 12883 in *Arabidopsis thaliana* conferred an increased NUE and an increased biomass production compared with the wild type control.

In particular, it was observed that increasing or generating the activity of a gene product with the activity of a "Alkyl/aryl-sulfatase" encoded by a gene comprising the nucleic acid sequence SEQ ID NO. 12889 in *Arabidopsis thaliana* conferred an increased yield, especially an increased NUE compared with the wild type control.

It was further observed that increasing or generating the activity of a gene product with the activity of a "Alkyl/aryl-sulfatase" encoded by a gene comprising the nucleic acid sequence SEQ ID NO.: 12889 in *Arabidopsis thaliana* conferred an increased biomass production compared with the wild type control.

It was further observed that increasing or generating the activity of a gene product with the activity of a "Alkyl/aryl-sulfatase" encoded by a gene comprising the nucleic acid sequence SEQ ID NO. 12889 in *Arabidopsis thaliana* conferred an increased NUE and an increased biomass production compared with the wild type control.

In particular, it was observed that increasing or generating the activity of a gene product with the activity of a "antiviral adaptor protein" encoded by a gene comprising the nucleic acid sequence SEQ ID NO. 13014 in *Arabidopsis thaliana* conferred an increased yield, especially an increased NUE compared with the wild type control.

It was further observed that increasing or generating the activity of a gene product with the activity of a "antiviral adaptor protein" encoded by a gene comprising the nucleic acid sequence SEQ ID NO.: 13014 in *Arabidopsis thaliana* conferred an increased biomass production compared with the wild type control.

It was further observed that increasing or generating the activity of a gene product with the activity of a "antiviral adaptor protein" encoded by a gene comprising the nucleic acid sequence SEQ ID NO. 13014 in *Arabidopsis thaliana* conferred an increased NUE and an increased biomass production compared with the wild type control.

In particular, it was observed that increasing or generating the activity of a gene product with the activity of a "repressor of G1 transcription" encoded by a gene comprising the nucleic acid sequence SEQ ID NO. 13018 in *Arabidopsis thaliana* conferred an increased yield, especially an increased NUE compared with the wild type control.

It was further observed that increasing or generating the activity of a gene product with the activity of a "repressor of G1 transcription" encoded by a gene comprising the nucleic acid sequence SEQ ID NO.: 13018 in *Arabidopsis thaliana* conferred an increased biomass production compared with the wild type control.

It was further observed that increasing or generating the activity of a gene product with the activity of a "repressor of G1 transcription" encoded by a gene comprising the nucleic acid sequence SEQ ID NO. 13018 in *Arabidopsis thaliana* conferred an increased NUE and an increased biomass production compared with the wild type control.

In particular, it was observed that increasing or generating the activity of a gene product with the activity of a "YOR097C-protein" encoded by a gene comprising the nucleic acid sequence SEQ ID NO. 13024 in *Arabidopsis thaliana* conferred an increased yield, especially an increased NUE compared with the wild type control.

It was further observed that increasing or generating the activity of a gene product with the activity of a "YOR097C-protein" encoded by a gene comprising the nucleic acid sequence SEQ ID NO.: 13024 in *Arabidopsis thaliana* conferred an increased biomass production compared with the wild type control.

It was further observed that increasing or generating the activity of a gene product with the activity of a "YOR097C-protein" encoded by a gene comprising the nucleic acid sequence SEQ ID NO. 13024 in *Arabidopsis thaliana* conferred an increased NUE and an increased biomass production compared with the wild type control.

In particular, it was observed that increasing or generating the activity of a gene product with the activity of a "Phosphoribosylaminoimidazole carboxylase" encoded by a gene comprising the nucleic acid sequence SEQ ID NO. 13030 in *Arabidopsis thaliana* conferred an increased yield, especially an increased NUE compared with the wild type control.

It was further observed that increasing or generating the activity of a gene product with the activity of a "Phosphoribosylaminoimidazole carboxylase" encoded by a gene comprising the nucleic acid sequence SEQ ID NO.: 13030 in *Arabidopsis thaliana* conferred an increased biomass production compared with the wild type control.

It was further observed that increasing or generating the activity of a gene product with the activity of a "Phosphoribosylaminoimidazole carboxylase" encoded by a gene comprising the nucleic acid sequence SEQ ID NO. 13030 in *Arabidopsis thaliana* conferred an increased NUE and an increased biomass production compared with the wild type control.

In particular, it was observed that increasing or generating the activity of a gene product with the activity of a "component of the RAM signaling network" encoded by a gene comprising the nucleic acid sequence SEQ ID NO. 14085 in *Arabidopsis thaliana* conferred an increased yield, especially an increased NUE compared with the wild type control.

It was further observed that increasing or generating the activity of a gene product with the activity of a "component of the RAM signaling network" encoded by a gene comprising the nucleic acid sequence SEQ ID NO.: 14085 in *Arabidopsis thaliana* conferred an increased biomass production compared with the wild type control.

It was further observed that increasing or generating the activity of a gene product with the activity of a "component of the RAM signaling network" encoded by a gene comprising the nucleic acid sequence SEQ ID NO. 14085 in *Arabidopsis thaliana* conferred an increased NUE and an increased biomass production compared with the wild type control.

In particular, it was observed that increasing or generating the activity of a gene product with the activity of a "protein kinase" encoded by a gene comprising the nucleic acid sequence SEQ ID NO. 14093 in *Arabidopsis thaliana* conferred an increased yield, especially an increased NUE compared with the wild type control.

It was further observed that increasing or generating the activity of a gene product with the activity of a "protein kinase" encoded by a gene comprising the nucleic acid sequence SEQ ID NO.: 14093 in *Arabidopsis thaliana* conferred an increased biomass production compared with the wild type control.

It was further observed that increasing or generating the activity of a gene product with the activity of a "protein kinase" encoded by a gene comprising the nucleic acid sequence SEQ ID NO. 14093 in *Arabidopsis thaliana* conferred an increased NUE and an increased biomass production compared with the wild type control.

In particular, it was observed that increasing or generating the activity of a gene product with the activity of a "signal recognition particle subunit (SRP54)" encoded by a gene comprising the nucleic acid sequence SEQ ID NO. 14113 in *Arabidopsis thaliana* conferred an increased yield, especially an increased NUE compared with the wild type control.

It was further observed that increasing or generating the activity of a gene product with the activity of a "signal recognition particle subunit (SRP54)" encoded by a gene comprising the nucleic acid sequence SEQ ID NO.: 14113 in

*Arabidopsis thaliana* conferred an increased biomass production compared with the wild type control.

It was further observed that increasing or generating the activity of a gene product with the activity of a "signal recognition particle subunit (SRP54)" encoded by a gene comprising the nucleic acid sequence SEQ ID NO. 14113 in *Arabidopsis thaliana* conferred an increased NUE and an increased biomass production compared with the wild type control.

In particular, it was observed that increasing or generating the activity of a gene product with the activity of a "regulatory subunit of the 26S proteasome" encoded by a gene comprising the nucleic acid sequence SEQ ID NO. 14246 in *Arabidopsis thaliana* conferred an increased yield, especially an increased NUE compared with the wild type control.

It was further observed that increasing or generating the activity of a gene product with the activity of a "regulatory subunit of the 26S proteasome" encoded by a gene comprising the nucleic acid sequence SEQ ID NO.: 14246 in *Arabidopsis thaliana* conferred an increased biomass production compared with the wild type control.

It was further observed that increasing or generating the activity of a gene product with the activity of a "regulatory subunit of the 26S proteasome" encoded by a gene comprising the nucleic acid sequence SEQ ID NO. 14246 in *Arabidopsis thaliana* conferred an increased NUE and an increased biomass production compared with the wild type control.

In particular, it was observed that increasing or generating the activity of a gene product with the activity of a "RNA polymerase III subunit" encoded by a gene comprising the nucleic acid sequence SEQ ID NO. 14311 in *Arabidopsis thaliana* conferred an increased yield, especially an increased NUE compared with the wild type control.

It was further observed that increasing or generating the activity of a gene product with the activity of a "RNA polymerase III subunit" encoded by a gene comprising the nucleic acid sequence SEQ ID NO.: 14311 in *Arabidopsis thaliana* conferred an increased biomass production compared with the wild type control.

It was further observed that increasing or generating the activity of a gene product with the activity of a "RNA polymerase III subunit" encoded by a gene comprising the nucleic acid sequence SEQ ID NO. 14311 in *Arabidopsis thaliana* conferred an increased NUE and an increased biomass production compared with the wild type control.

In particular, it was observed that increasing or generating the activity of a gene product with the activity of a "lysophospholipase" encoded by a gene comprising the nucleic acid sequence SEQ ID NO. 14914 in *Arabidopsis thaliana* conferred an increased yield, especially an increased NUE compared with the wild type control.

It was further observed that increasing or generating the activity of a gene product with the activity of a "lysophospholipase" encoded by a gene comprising the nucleic acid sequence SEQ ID NO.: 14914 in *Arabidopsis thaliana* conferred an increased biomass production compared with the wild type control.

It was further observed that increasing or generating the activity of a gene product with the activity of a "lysophospholipase" encoded by a gene comprising the nucleic acid sequence SEQ ID NO. 14914 in *Arabidopsis thaliana* conferred an increased NUE and an increased biomass production compared with the wild type control.

In particular, it was observed that increasing or generating the activity of a gene product with the activity of a "saccharopine dehydrogenase" encoded by a gene comprising the nucleic acid sequence SEQ ID NO. 15382 in *Arabidopsis thaliana* conferred an increased yield, especially an increased NUE compared with the wild type control.

It was further observed that increasing or generating the activity of a gene product with the activity of a "saccharopine dehydrogenase" encoded by a gene comprising the nucleic acid sequence SEQ ID NO.: 15382 in *Arabidopsis thaliana* conferred an increased biomass production compared with the wild type control.

It was further observed that increasing or generating the activity of a gene product with the activity of a "saccharopine dehydrogenase" encoded by a gene comprising the nucleic acid sequence SEQ ID NO. 15382 in *Arabidopsis thaliana* conferred an increased NUE and an increased biomass production compared with the wild type control.

In particular, it was observed that increasing or generating the activity of a gene product with the activity of a "alpha-mannosidase" encoded by a gene comprising the nucleic acid sequence SEQ ID NO. 15460 in *Arabidopsis thaliana* conferred an increased yield, especially an increased NUE compared with the wild type control.

It was further observed that increasing or generating the activity of a gene product with the activity of a "alpha-mannosidase" encoded by a gene comprising the nucleic acid sequence SEQ ID NO.: 15460 in *Arabidopsis thaliana* conferred an increased biomass production compared with the wild type control.

It was further observed that increasing or generating the activity of a gene product with the activity of a "alpha-mannosidase" encoded by a gene comprising the nucleic acid sequence SEQ ID NO. 15460 in *Arabidopsis thaliana* conferred an increased NUE and an increased biomass production compared with the wild type control.

In particular, it was observed that increasing or generating the activity of a gene product with the activity of a "ykl100c-protein" encoded by a gene comprising the nucleic acid sequence SEQ ID NO. 15571 in *Arabidopsis thaliana* conferred an increased yield, especially an increased NUE compared with the wild type control.

It was further observed that increasing or generating the activity of a gene product with the activity of a "ykl100c-protein" encoded by a gene comprising the nucleic acid sequence SEQ ID NO.: 15571 in *Arabidopsis thaliana* conferred an increased biomass production compared with the wild type control.

It was further observed that increasing or generating the activity of a gene product with the activity of a "ykl100c-protein" encoded by a gene comprising the nucleic acid sequence SEQ ID NO. 15571 in *Arabidopsis thaliana* conferred an increased NUE and an increased biomass production compared with the wild type control.

In particular, it was observed that increasing or generating the activity of a gene product with the activity of a "regulatory subunit of Glc7p type 1 protein serine-threonine phosphatase" encoded by a gene comprising the nucleic acid sequence SEQ ID NO. 15593 in *Arabidopsis thaliana* conferred an increased yield, especially an increased NUE compared with the wild type control.

It was further observed that increasing or generating the activity of a gene product with the activity of a "regulatory subunit of Glc7p type 1 protein serine-threonine phosphatase" encoded by a gene comprising the nucleic acid sequence SEQ ID NO.: 15593 in *Arabidopsis thaliana* conferred an increased biomass production compared with the wild type control.

It was further observed that increasing or generating the activity of a gene product with the activity of a "regulatory subunit of Glc7p type 1 protein serine-threonine phosphatase" encoded by a gene comprising the nucleic acid sequence SEQ ID NO. 15593 in *Arabidopsis thaliana* conferred an increased NUE and an increased biomass production compared with the wild type control.

In particular, it was observed that increasing or generating the activity of a gene product with the activity of a "non-essential Ras guanine nucleotide exchange factor" encoded by a gene comprising the nucleic acid sequence SEQ ID NO. 15646 in *Arabidopsis thaliana* conferred an increased yield, especially an increased NUE compared with the wild type control.

It was further observed that increasing or generating the activity of a gene product with the activity of a "non-essential Ras guanine nucleotide exchange factor" encoded by a gene comprising the nucleic acid sequence SEQ ID NO.: 15646 in *Arabidopsis thaliana* conferred an increased biomass production compared with the wild type control.

It was further observed that increasing or generating the activity of a gene product with the activity of a "non-essential Ras guanine nucleotide exchange factor" encoded by a gene comprising the nucleic acid sequence SEQ ID NO. 15646 in *Arabidopsis thaliana* conferred an increased NUE and an increased biomass production compared with the wild type control.

In particular, it was observed that increasing or generating the activity of a gene product with the activity of a "metal ion transporter" encoded by a gene comprising the nucleic acid sequence SEQ ID NO. 15673 in *Arabidopsis thaliana* conferred an increased yield, especially an increased NUE compared with the wild type control.

It was further observed that increasing or generating the activity of a gene product with the activity of a "metal ion transporter" encoded by a gene comprising the nucleic acid sequence SEQ ID NO.: 15673 in *Arabidopsis thaliana* conferred an increased biomass production compared with the wild type control.

It was further observed that increasing or generating the activity of a gene product with the activity of a "metal ion transporter" encoded by a gene comprising the nucleic acid sequence SEQ ID NO. 15673 in *Arabidopsis thaliana* conferred an increased NUE and an increased biomass production compared with the wild type control.

In particular, it was observed that increasing or generating the activity of a gene product with the activity of a "subunit of cytoplasmic phenylalanyl-tRNA synthetase" encoded by a gene comprising the nucleic acid sequence SEQ ID NO. 16005 in *Arabidopsis thaliana* conferred an increased yield, especially an increased NUE compared with the wild type control.

It was further observed that increasing or generating the activity of a gene product with the activity of a "subunit of cytoplasmic phenylalanyl-tRNA synthetase" encoded by a gene comprising the nucleic acid sequence SEQ ID NO.: 16005 in *Arabidopsis thaliana* conferred an increased biomass production compared with the wild type control.

It was further observed that increasing or generating the activity of a gene product with the activity of a "subunit of cytoplasmic phenylalanyl-tRNA synthetase" encoded by a gene comprising the nucleic acid sequence SEQ ID NO. 16005 in *Arabidopsis thaliana* conferred an increased NUE and an increased biomass production compared with the wild type control.

In particular, it was observed that increasing or generating the activity of a gene product with the activity of a "YMR082C-protein" encoded by a gene comprising the nucleic acid sequence SEQ ID NO. 16114 in *Arabidopsis thaliana* conferred an increased yield, especially an increased NUE compared with the wild type control.

It was further observed that increasing or generating the activity of a gene product with the activity of a "YMR082C-protein" encoded by a gene comprising the nucleic acid sequence SEQ ID NO.: 16114 in *Arabidopsis thaliana* conferred an increased biomass production compared with the wild type control.

It was further observed that increasing or generating the activity of a gene product with the activity of a "YMR082C-protein" encoded by a gene comprising the nucleic acid sequence SEQ ID NO. 16114 in *Arabidopsis thaliana* conferred an increased NUE and an increased biomass production compared with the wild type control.

In particular, it was observed that increasing or generating the activity of a gene product with the activity of a "B1258-protein" encoded by a gene comprising the nucleic acid sequence SEQ ID NO. 14402 in *Arabidopsis thaliana* conferred an increased yield, especially an increased NUE compared with the wild type control.

It was further observed that increasing or generating the activity of a gene product with the activity of a "B1258-protein" encoded by a gene comprising the nucleic acid sequence SEQ ID NO.: 14402 in *Arabidopsis thaliana* conferred an increased biomass production compared with the wild type control.

It was further observed that increasing or generating the activity of a gene product with the activity of a "B1258-protein" encoded by a gene comprising the nucleic acid sequence SEQ ID NO. 14402 in *Arabidopsis thaliana* conferred an increased NUE and an increased biomass production compared with the wild type control.

In particular, it was observed that increasing or generating the activity of a gene product with the activity of a "YML101C-protein" encoded by a gene comprising the nucleic acid sequence SEQ ID NO. 16093 in *Arabidopsis thaliana* conferred an increased yield, especially an increased NUE compared with the wild type control.

It was further observed that increasing or generating the activity of a gene product with the activity of a "YML101C-protein" encoded by a gene comprising the nucleic acid sequence SEQ ID NO.: 16093 in *Arabidopsis thaliana* conferred an increased biomass production compared with the wild type control.

It was further observed that increasing or generating the activity of a gene product with the activity of a "YML101C-protein" encoded by a gene comprising the nucleic acid sequence SEQ ID NO. 16093 in *Arabidopsis thaliana* conferred an increased NUE and an increased biomass production compared with the wild type control.

In particular, it was observed that increasing or generating the activity of a gene product with the activity of a "nuclear fusion protein precursor" encoded by a gene comprising the nucleic acid sequence SEQ ID NO. 16106 in *Arabidopsis thaliana* conferred an increased yield, especially an increased NUE compared with the wild type control.

It was further observed that increasing or generating the activity of a gene product with the activity of a "nuclear fusion protein precursor" encoded by a gene comprising the nucleic acid sequence SEQ ID NO.: 16106 in *Arabidopsis thaliana* conferred an increased biomass production compared with the wild type control.

It was further observed that increasing or generating the activity of a gene product with the activity of a "nuclear fusion protein precursor" encoded by a gene comprising the nucleic acid sequence SEQ ID NO. 16106 in *Arabidopsis thaliana* conferred an increased NUE and an increased biomass production compared with the wild type control.

In particular, it was observed that increasing or generating the activity of a gene product with the activity of a "inheritance of peroxisomes protein" encoded by a gene comprising the nucleic acid sequence SEQ ID NO. 16120 in *Arabidopsis thaliana* conferred an increased yield, especially an increased NUE compared with the wild type control.

It was further observed that increasing or generating the activity of a gene product with the activity of a "inheritance of peroxisomes protein" encoded by a gene comprising the nucleic acid sequence SEQ ID NO.: 16120 in *Arabidopsis thaliana* conferred an increased biomass production compared with the wild type control.

It was further observed that increasing or generating the activity of a gene product with the activity of a "inheritance of peroxisomes protein" encoded by a gene comprising the nucleic acid sequence SEQ ID NO. 16120 in *Arabidopsis thaliana* conferred an increased NUE and an increased biomass production compared with the wild type control.

In particular, it was observed that increasing or generating the activity of a gene product with the activity of a "exoribonuclease" encoded by a gene comprising the nucleic acid sequence SEQ ID NO. 16275 in *Arabidopsis thaliana* conferred an increased yield, especially an increased NUE compared with the wild type control.

It was further observed that increasing or generating the activity of a gene product with the activity of a "exoribonuclease" encoded by a gene comprising the nucleic acid sequence SEQ ID NO.: 16275 in *Arabidopsis thaliana* conferred an increased biomass production compared with the wild type control.

It was further observed that increasing or generating the activity of a gene product with the activity of a "exoribonuclease" encoded by a gene comprising the nucleic acid sequence SEQ ID NO. 16275 in *Arabidopsis thaliana* conferred an increased NUE and an increased biomass production compared with the wild type control.

In particular, it was observed that increasing or generating the activity of a gene product with the activity of a "iron sulfur cluster assembly protein" encoded by a gene comprising the nucleic acid sequence SEQ ID NO. 16305 in *Arabidopsis thaliana* conferred an increased yield, especially an increased NUE compared with the wild type control.

It was further observed that increasing or generating the activity of a gene product with the activity of a "iron sulfur cluster assembly protein" encoded by a gene comprising the nucleic acid sequence SEQ ID NO.: 16305 in *Arabidopsis thaliana* conferred an increased biomass production compared with the wild type control.

It was further observed that increasing or generating the activity of a gene product with the activity of a "iron sulfur cluster assembly protein" encoded by a gene comprising the nucleic acid sequence SEQ ID NO. 16305 in *Arabidopsis thaliana* conferred an increased NUE and an increased biomass production compared with the wild type control.

In particular, it was observed that increasing or generating the activity of a gene product with the activity of a "YPL068C-protein" encoded by a gene comprising the nucleic acid sequence SEQ ID NO. 16573 in *Arabidopsis thaliana* conferred an increased yield, especially an increased NUE compared with the wild type control.

It was further observed that increasing or generating the activity of a gene product with the activity of a "YPL068C-protein" encoded by a gene comprising the nucleic acid sequence SEQ ID NO.: 16573 in *Arabidopsis thaliana* conferred an increased biomass production compared with the wild type control.

It was further observed that increasing or generating the activity of a gene product with the activity of a "YPL068C-protein" encoded by a gene comprising the nucleic acid sequence SEQ ID NO. 16573 in *Arabidopsis thaliana* conferred an increased NUE and an increased biomass production compared with the wild type control.

In particular, it was observed that increasing or generating the activity of a gene product with the activity of a "B0165-protein" encoded by a gene comprising the nucleic acid sequence SEQ ID NO. 14396 in *Arabidopsis thaliana* conferred an increased yield, especially an increased NUE compared with the wild type control.

It was further observed that increasing or generating the activity of a gene product with the activity of a "B0165-protein" encoded by a gene comprising the nucleic acid sequence SEQ ID NO.: 14396 in *Arabidopsis thaliana* conferred an increased biomass production compared with the wild type control.

It was further observed that increasing or generating the activity of a gene product with the activity of a "B0165-protein" encoded by a gene comprising the nucleic acid sequence SEQ ID NO. 14396 in *Arabidopsis thaliana* conferred an increased NUE and an increased biomass production compared with the wild type control.

In particular, it was observed that increasing or generating the activity of a gene product with the activity of a "YOR203W-protein" encoded by a gene comprising the nucleic acid sequence SEQ ID NO. 16299 in *Arabidopsis thaliana* conferred an increased yield, especially an increased NUE compared with the wild type control.

It was further observed that increasing or generating the activity of a gene product with the activity of a "YOR203W-protein" encoded by a gene comprising the nucleic acid sequence SEQ ID NO.: 16299 in *Arabidopsis thaliana* conferred an increased biomass production compared with the wild type control.

It was further observed that increasing or generating the activity of a gene product with the activity of a "YOR203W-protein" encoded by a gene comprising the nucleic acid sequence SEQ ID NO. 16299 in *Arabidopsis thaliana* conferred an increased NUE and an increased biomass production compared with the wild type control.

In particular, it was observed that increasing or generating the activity of a gene product with the activity of a "ribonucleoprotein" encoded by a gene comprising the nucleic acid sequence SEQ ID NO. 16133 in *Arabidopsis thaliana* conferred an increased yield, especially an increased NUE compared with the wild type control.

It was further observed that increasing or generating the activity of a gene product with the activity of a "ribonucleoprotein" encoded by a gene comprising the nucleic acid sequence SEQ ID NO.: 16133 in *Arabidopsis thaliana* conferred an increased biomass production compared with the wild type control.

It was further observed that increasing or generating the activity of a gene product with the activity of a "ribonucleoprotein" encoded by a gene comprising the nucleic acid sequence SEQ ID NO. 16133 in *Arabidopsis thaliana* conferred an increased NUE and an increased biomass production compared with the wild type control.

In particular, it was observed that increasing or generating the activity of a gene product with the activity of a "transcription factor" encoded by a gene comprising the nucleic acid sequence SEQ ID NO. 15056 in *Arabidopsis thaliana* conferred an increased yield, especially an increased NUE compared with the wild type control.

It was further observed that increasing or generating the activity of a gene product with the activity of a "transcription factor" encoded by a gene comprising the nucleic acid sequence SEQ ID NO.: 15056 in *Arabidopsis thaliana* conferred an increased biomass production compared with the wild type control.

It was further observed that increasing or generating the activity of a gene product with the activity of a "transcription factor" encoded by a gene comprising the nucleic acid sequence SEQ ID NO. 15056 in *Arabidopsis thaliana* conferred an increased NUE and an increased biomass production compared with the wild type control.

In particular, it was observed that increasing or generating the activity of a gene product with the activity of a "YKL111C-protein" encoded by a gene comprising the nucleic acid sequence SEQ ID NO. 15587 in *Arabidopsis thaliana* conferred an increased yield, especially an increased NUE compared with the wild type control.

It was further observed that increasing or generating the activity of a gene product with the activity of a "YKL111C-protein" encoded by a gene comprising the nucleic acid sequence SEQ ID NO.: 15587 in *Arabidopsis thaliana* conferred an increased biomass production compared with the wild type control.

It was further observed that increasing or generating the activity of a gene product with the activity of a "YKL111C-protein" encoded by a gene comprising the nucleic acid sequence SEQ ID NO. 15587 in *Arabidopsis thaliana* conferred an increased NUE and an increased biomass production compared with the wild type control.

In particular, it was observed that increasing or generating the activity of a gene product with the activity of a "iron sulfur cluster assembly protein" encoded by a gene comprising the nucleic acid sequence SEQ ID NO. 16582 in *Arabidopsis thaliana* conferred an increased yield, especially an increased NUE compared with the wild type control.

It was further observed that increasing or generating the activity of a gene product with the activity of a "iron sulfur cluster assembly protein" encoded by a gene comprising the nucleic acid sequence SEQ ID NO.: 16582 in *Arabidopsis thaliana* conferred an increased biomass production compared with the wild type control.

It was further observed that increasing or generating the activity of a gene product with the activity of a "iron sulfur cluster assembly protein" encoded by a gene comprising the nucleic acid sequence SEQ ID NO. 16582 in *Arabidopsis thaliana* conferred an increased NUE and an increased biomass production compared with the wild type control.

In particular, it was observed that increasing or generating the activity of a gene product with the activity of a "transport protein" encoded by a gene comprising the nucleic acid sequence SEQ ID NO. 14839 in *Arabidopsis thaliana* conferred an increased yield, especially an increased NUE compared with the wild type control.

It was further observed that increasing or generating the activity of a gene product with the activity of a "transport protein" encoded by a gene comprising the nucleic acid sequence SEQ ID NO.: 14839 in *Arabidopsis thaliana* conferred an increased biomass production compared with the wild type control.

It was further observed that increasing or generating the activity of a gene product with the activity of a "transport protein" encoded by a gene comprising the nucleic acid sequence SEQ ID NO. 14839 in *Arabidopsis thaliana* conferred an increased NUE and an increased biomass production compared with the wild type control.

In particular, it was observed that increasing or generating the activity of a gene product with the activity of a "protein translocase protein" encoded by a gene comprising the nucleic acid sequence SEQ ID NO. 15014 in *Arabidopsis thaliana* conferred an increased yield, especially an increased NUE compared with the wild type control.

It was further observed that increasing or generating the activity of a gene product with the activity of a "protein translocase protein" encoded by a gene comprising the nucleic acid sequence SEQ ID NO.: 15014 in *Arabidopsis thaliana* conferred an increased biomass production compared with the wild type control.

It was further observed that increasing or generating the activity of a gene product with the activity of a "protein translocase protein" encoded by a gene comprising the nucleic acid sequence SEQ ID NO. 15014 in *Arabidopsis thaliana* conferred an increased NUE and an increased biomass production compared with the wild type control.

In particular, it was observed that increasing or generating the activity of a gene product with the activity of a "YJL010C-protein" encoded by a gene comprising the nucleic acid sequence SEQ ID NO. 15432 in *Arabidopsis thaliana* conferred an increased yield, especially an increased NUE compared with the wild type control.

It was further observed that increasing or generating the activity of a gene product with the activity of a "YJL010C-protein" encoded by a gene comprising the nucleic acid sequence SEQ ID NO.: 15432 in *Arabidopsis thaliana* conferred an increased biomass production compared with the wild type control.

It was further observed that increasing or generating the activity of a gene product with the activity of a "YJL010C-protein" encoded by a gene comprising the nucleic acid sequence SEQ ID NO. 15432 in *Arabidopsis thaliana* conferred an increased NUE and an increased biomass production compared with the wild type control.

In particular, it was observed that increasing or generating the activity of a gene product with the activity of a "B1267-protein" encoded by a gene comprising the nucleic acid sequence SEQ ID NO. 14497 in *Arabidopsis thaliana* conferred an increased yield, especially an increased NUE compared with the wild type control.

It was further observed that increasing or generating the activity of a gene product with the activity of a "B1267-protein" encoded by a gene comprising the nucleic acid sequence SEQ ID NO.: 14497 in *Arabidopsis thaliana* conferred an increased biomass production compared with the wild type control.

It was further observed that increasing or generating the activity of a gene product with the activity of a "B1267-protein" encoded by a gene comprising the nucleic acid sequence SEQ ID NO. 14497 in *Arabidopsis thaliana* conferred an increased NUE and an increased biomass production compared with the wild type control.

In particular, it was observed that increasing or generating the activity of a gene product with the activity of a "membrane protein" encoded by a gene comprising the nucleic acid sequence SEQ ID NO. 14718 in *Arabidopsis thaliana* conferred an increased yield, especially an increased NUE compared with the wild type control.

It was further observed that increasing or generating the activity of a gene product with the activity of a "membrane protein" encoded by a gene comprising the nucleic acid sequence SEQ ID NO.: 14718 in *Arabidopsis thaliana* conferred an increased biomass production compared with the wild type control.

It was further observed that increasing or generating the activity of a gene product with the activity of a "membrane protein" encoded by a gene comprising the nucleic acid sequence SEQ ID NO. 14718 in *Arabidopsis thaliana* conferred an increased NUE and an increased biomass production compared with the wild type control.

In particular, it was observed that increasing or generating the activity of a gene product with the activity of a "B1381-protein" encoded by a gene comprising the nucleic acid sequence SEQ ID NO. 14791 in *Arabidopsis thaliana* conferred an increased yield, especially an increased NUE compared with the wild type control.

It was further observed that increasing or generating the activity of a gene product with the activity of a "B1381-protein" encoded by a gene comprising the nucleic acid sequence SEQ ID NO.: 14791 in *Arabidopsis thaliana* conferred an increased biomass production compared with the wild type control.

It was further observed that increasing or generating the activity of a gene product with the activity of a "B1381-protein" encoded by a gene comprising the nucleic acid sequence SEQ ID NO. 14791 in *Arabidopsis thaliana* conferred an increased NUE and an increased biomass production compared with the wild type control.

In particular, it was observed that increasing or generating the activity of a gene product with the activity of a "B2646-protein" encoded by a gene comprising the nucleic acid sequence SEQ ID NO. 14879 in *Arabidopsis thaliana* conferred an increased yield, especially an increased NUE compared with the wild type control.

It was further observed that increasing or generating the activity of a gene product with the activity of a "B2646-protein" encoded by a gene comprising the nucleic acid sequence SEQ ID NO.: 14879 in *Arabidopsis thaliana* conferred an increased biomass production compared with the wild type control.

It was further observed that increasing or generating the activity of a gene product with the activity of a "B2646-protein" encoded by a gene comprising the nucleic acid sequence SEQ ID NO. 14879 in *Arabidopsis thaliana* conferred an increased NUE and an increased biomass production compared with the wild type control.

In particular, it was observed that increasing or generating the activity of a gene product with the activity of a "60S ribosomal protein" encoded by a gene comprising the nucleic acid sequence SEQ ID NO. 15064 in *Arabidopsis thaliana* conferred an increased yield, especially an increased NUE compared with the wild type control.

It was further observed that increasing or generating the activity of a gene product with the activity of a "60S ribosomal protein" encoded by a gene comprising the nucleic acid sequence SEQ ID NO.: 15064 in *Arabidopsis thaliana* conferred an increased biomass production compared with the wild type control.

It was further observed that increasing or generating the activity of a gene product with the activity of a "60S ribosomal protein" encoded by a gene comprising the nucleic acid sequence SEQ ID NO. 15064 in *Arabidopsis thaliana* conferred an increased NUE and an increased biomass production compared with the wild type control.

In particular, it was observed that increasing or generating the activity of a gene product with the activity of a "Rho GDP-dissociation inhibitor" encoded by a gene comprising the nucleic acid sequence SEQ ID NO. 15257 in *Arabidopsis thaliana* conferred an increased yield, especially an increased NUE compared with the wild type control.

It was further observed that increasing or generating the activity of a gene product with the activity of a "Rho GDP-dissociation inhibitor" encoded by a gene comprising the nucleic acid sequence SEQ ID NO.: 15257 in *Arabidopsis thaliana* conferred an increased biomass production compared with the wild type control.

It was further observed that increasing or generating the activity of a gene product with the activity of a "Rho GDP-dissociation inhibitor" encoded by a gene comprising the nucleic acid sequence SEQ ID NO. 15257 in *Arabidopsis thaliana* conferred an increased NUE and an increased biomass production compared with the wild type control.

In particular, it was observed that increasing or generating the activity of a gene product with the activity of a "YHL005C-protein" encoded by a gene comprising the nucleic acid sequence SEQ ID NO. 15378 in *Arabidopsis thaliana* conferred an increased yield, especially an increased NUE compared with the wild type control.

It was further observed that increasing or generating the activity of a gene product with the activity of a "YHL005C-protein" encoded by a gene comprising the nucleic acid sequence SEQ ID NO.: 15378 in *Arabidopsis thaliana* conferred an increased biomass production compared with the wild type control.

It was further observed that increasing or generating the activity of a gene product with the activity of a "YHL005C-protein" encoded by a gene comprising the nucleic acid sequence SEQ ID NO. 15378 in *Arabidopsis thaliana* conferred an increased NUE and an increased biomass production compared with the wild type control.

In particular, it was observed that increasing or generating the activity of a gene product with the activity of a "transmembrane protein with a role in cell wall polymer composition" encoded by a gene comprising the nucleic acid sequence SEQ ID NO. 16629 in *Arabidopsis thaliana* conferred an increased yield, especially an increased NUE compared with the wild type control.

It was further observed that increasing or generating the activity of a gene product with the activity of a "transmembrane protein with a role in cell wall polymer composition" encoded by a gene comprising the nucleic acid sequence SEQ ID NO.: 16629 in *Arabidopsis thaliana* conferred an increased biomass production compared with the wild type control.

It was further observed that increasing or generating the activity of a gene product with the activity of a "transmembrane protein with a role in cell wall polymer composition" encoded by a gene comprising the nucleic acid sequence SEQ ID NO. 16629 in *Arabidopsis thaliana* conferred an increased NUE and an increased biomass production compared with the wild type control.

In particular, it was observed that increasing or generating the activity of a gene product with the activity of a "Stationary phase protein" encoded by a gene comprising the nucleic acid sequence SEQ ID NO. 16647 in *Arabidopsis thaliana* conferred an increased yield, especially an increased NUE compared with the wild type control.

It was further observed that increasing or generating the activity of a gene product with the activity of a "Stationary phase protein" encoded by a gene comprising the nucleic acid sequence SEQ ID NO.: 16647 in *Arabidopsis thaliana* conferred an increased biomass production compared with the wild type control.

It was further observed that increasing or generating the activity of a gene product with the activity of a "Stationary phase protein" encoded by a gene comprising the nucleic acid sequence SEQ ID NO. 16647 in *Arabidopsis thaliana* conferred an increased NUE and an increased biomass production compared with the wild type control.

Thus, according to the method of the invention an enhanced NUE and/or increased biomass production in a plant cell, plant or a part thereof compared to a control or wild type can be achieved.

Accordingly, in one embodiment, in case the activity of a polypeptide according to the polypeptide SEQ ID NO. 39, or encoded by a nucleic acid molecule comprising the nucleic acid SEQ ID NO. 38 or a nucleic acid which differs from the nucleic acid SEQ ID NO. 38 by exchanging the stop codon taa by tga or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 38 or polypeptide SEQ ID NO. 39, respectively is increased or generated or if the activity "b0017-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 43, or encoded by a nucleic acid molecule comprising the nucleic acid SEQ ID NO. 42 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 42 or polypeptide SEQ ID NO. 43, respectively is increased or generated or if the activity "transport protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 124, or encoded by a nucleic acid molecule comprising the nucleic acid SEQ ID NO. 123 or a nucleic acid which differs from the nucleic acid SEQ ID NO. 123 by exchanging the stop codon taa by tga or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 123 or polypeptide SEQ ID NO. 124, respectively is increased or generated or if the activity "hydroxymyristol acyl carrier protein dehydratase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 381, or encoded by a nucleic acid molecule comprising the nucleic acid SEQ ID NO. 380 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 380 or polypeptide SEQ ID NO. 381, respectively is increased or generated or if the activity "gamma-glutamyl kinase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 680, or encoded by a nucleic acid molecule comprising the nucleic acid SEQ ID NO. 679 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 679 or polypeptide SEQ ID NO. 680, respectively is increased or generated or if the activity "alpha-glucosidase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 813, or encoded by a nucleic acid molecule comprising the nucleic acid SEQ ID NO. 812 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 812 or polypeptide SEQ ID NO. 813, respectively is increased or generated or if the activity "adenylate kinase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 1056, or encoded by a nucleic acid molecule comprising the nucleic acid SEQ ID NO. 1055 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 1055 or polypeptide SEQ ID NO. 1056, respectively is increased or generated or if the activity "2-dehydro-3-deoxy-phosphoheptonate aldolase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 1564, or encoded by a nucleic acid molecule comprising the nucleic acid SEQ ID NO. 1563 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 1563 or polypeptide SEQ ID NO. 1564, respectively is increased or generated or if the activity "molybdopterin biosynthesis protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 1706, or encoded by a nucleic acid molecule comprising the nucleic acid SEQ ID NO. 1705 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 1705 or polypeptide SEQ ID NO. 1706, respectively is increased or generated or if the activity "hydroxylamine reductase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 1845, or encoded by a nucleic acid molecule comprising the nucleic acid SEQ ID NO. 1844 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 1844 or polypeptide SEQ ID NO. 1845, respectively is increased or generated or if the activity "proline dehydrogenase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 1951, or encoded by a nucleic acid molecule comprising the nucleic acid SEQ ID NO. 1950 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 1950 or polypeptide SEQ ID NO. 1951, respectively is increased or generated or if the activity "PhoH-like protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 1976, or encoded by a nucleic acid molecule comprising the nucleic acid SEQ ID NO. 1975 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 1975 or polypeptide SEQ ID NO. 1976, respectively is increased or generated or if the activity "isomerase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2128, or encoded by a nucleic acid molecule comprising the nucleic acid SEQ ID NO. 2127 or a nucleic acid which differs from the nucleic acid SEQ ID NO. 2127 by exchanging the stop codon taa by tga or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2127 or polypeptide SEQ ID NO. 2128, respectively is increased or generated or if the activity "b1933-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2136, or encoded by a nucleic acid molecule comprising the nucleic acid SEQ ID NO. 2135 or a nucleic acid which differs from the nucleic acid SEQ ID NO. 2135 by exchanging the stop codon taa by tga or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2135 or polypeptide SEQ ID NO. 2136, respectively is increased or generated or if the activity "glycosyltransferase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2172, or encoded by a nucleic acid molecule comprising the nucleic acid SEQ ID NO. 2171 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2171 or polypeptide SEQ ID NO. 2172, respectively is increased or generated or if the activity "b2165-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2298, or encoded by a nucleic acid molecule comprising the nucleic acid SEQ ID NO. 2297 or a nucleic acid which differs from the nucleic acid SEQ ID NO. 2297 by exchanging the stop codon taa by tga or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2297 or polypeptide SEQ ID NO. 2298, respectively is increased or generated or if the activity "short chain fatty acid transporter" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2427, or encoded by a nucleic acid molecule comprising the nucleic acid SEQ ID NO. 2426 or a nucleic acid which differs from the nucleic acid SEQ ID NO. 2426 by exchanging the stop codon taa by tga or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2426 or polypeptide SEQ ID NO. 2427, respectively is increased or generated or if the activity "b2238-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2453, or encoded by a nucleic acid molecule comprising the nucleic acid SEQ ID NO. 2452 or a nucleic acid which differs from the nucleic acid SEQ ID NO. 2452 by exchanging the stop codon taa by tga or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2452 or polypeptide SEQ ID NO. 2453, respectively is increased or generated or if the activity "lysine/arginine/ornithine transporter subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2552, or encoded by a nucleic acid molecule comprising the nucleic acid SEQ ID NO. 2551 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2551 or polypeptide SEQ ID NO. 2552, respectively is increased or generated or if the activity "b2431-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2601, or encoded by a nucleic acid molecule comprising the nucleic acid SEQ ID NO. 2600 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2600 or polypeptide SEQ ID NO. 2601, respectively is increased or generated or if the activity "chorismate mutase T/prephenate dehydrogenase (bifunctional)" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2669, or encoded by a nucleic acid molecule comprising the nucleic acid SEQ ID NO. 2668 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2668 or polypeptide SEQ ID NO. 2669, respectively is increased or generated or if the activity "b2766-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 2773, or encoded by a nucleic acid molecule comprising the nucleic acid SEQ ID NO. 2772 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 2772 or polypeptide SEQ ID NO. 2773, respectively is increased or generated or if the activity "glycine decarboxylase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 3118, or encoded by a nucleic acid molecule comprising the nucleic acid SEQ ID NO. 3117 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 3117 or polypeptide SEQ ID NO. 3118, respectively is increased or generated or if the activity "threonine ammonia-lyase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 3391, or encoded by a nucleic acid molecule comprising the nucleic acid SEQ ID NO. 3390 or a nucleic acid which differs from the nucleic acid SEQ ID NO. 3390 by exchanging the stop codon taa by tga or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 3390 or polypeptide SEQ ID NO. 3391, respectively is increased or generated or if the activity "b3120-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 3397, or encoded by a nucleic acid molecule comprising the nucleic acid SEQ ID NO. 3396 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 3396 or polypeptide SEQ ID NO. 3397, respectively is increased or generated or if the activity "outer membrane usher protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 3471, or encoded by a nucleic acid molecule comprising the nucleic acid SEQ ID NO. 3470 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 3470 or polypeptide SEQ ID NO. 3471, respectively is increased or generated or if the activity "glycerol-3-phosphate transporter subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 3564, or encoded by a nucleic acid molecule comprising the nucleic acid SEQ ID NO. 3563 or a nucleic acid which differs from the nucleic acid SEQ ID NO. 3563 by exchanging the stop codon taa by tga or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 3563 or polypeptide SEQ ID NO. 3564, respectively is increased or generated or if the activity "hydro-lyase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 3771, or encoded by a nucleic acid molecule comprising the nucleic acid SEQ ID NO. 3770 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 3770 or polypeptide SEQ ID NO. 3771, respectively is increased or generated or if the activity "lysophospholipase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 3869, or encoded by a nucleic acid molecule comprising the nucleic acid SEQ ID NO. 3868 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 3868 or polypeptide SEQ ID NO. 3869, respectively is increased or generated or if the activity "yal019w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 3896, or encoded by a nucleic acid molecule comprising the nucleic acid SEQ ID NO. 3895 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 3895 or polypeptide SEQ ID NO. 3896, respectively is increased or generated or if the activity "carnitine acetyltransferase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 3954, or encoded by a nucleic acid molecule comprising the nucleic acid SEQ ID NO. 3953 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 3953 or polypeptide SEQ ID NO. 3954, respectively is increased or generated or if the activity "Transcriptional activator" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4112, or encoded by a nucleic acid molecule comprising the nucleic acid SEQ ID NO. 4111 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4111 or polypeptide SEQ ID NO. 4112, respectively is increased or generated or if the activity "splicing factor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4150, or encoded by a nucleic acid molecule comprising the nucleic acid SEQ ID NO. 4149 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4149 or polypeptide SEQ ID NO. 4150, respectively is increased or generated or if the activity "autophagy-specific phosphatidylinositol 3-kinase complex protein subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4163, or encoded by a nucleic acid molecule comprising the nucleic acid SEQ ID NO. 4162 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4162 or polypeptide SEQ ID NO. 4163, respectively is increased or generated or if the activity "microsomal beta-keto-reductase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4236, or encoded by a nucleic acid molecule comprising the nucleic acid SEQ ID NO. 4235 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4235 or polypeptide SEQ ID NO. 4236, respectively is increased or generated or if the activity "UDP-N-acetyl-glucosamine-1-P transferase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4281, or encoded by a nucleic acid molecule comprising the nucleic acid SEQ ID NO. 4280 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4280 or polypeptide SEQ ID NO. 4281, respectively is increased or generated or if the activity "ybr262c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4289, or encoded by a nucleic acid molecule comprising the nucleic acid SEQ ID NO. 4288 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4288 or polypeptide SEQ ID NO. 4289, respectively is increased or generated or if the activity "protein necessary for structural stability of L-A double-stranded RNA-containing particles" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4316, or encoded by a nucleic acid molecule comprising the nucleic acid SEQ ID NO. 4315 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4315 or polypeptide SEQ ID NO. 4316, respectively is increased or generated or if the activity "YDR070C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4326, or encoded by a nucleic acid molecule comprising the nucleic acid SEQ ID NO. 4325 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4325 or polypeptide SEQ ID NO. 4326, respectively is increased or generated or if the activity "chaperone" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4336, or encoded by a nucleic acid molecule comprising the nucleic acid SEQ ID NO. 4335 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4335 or polypeptide SEQ ID NO. 4336, respectively is increased or generated or if the activity "helix-loop-helix transcription activator that binds inositol/choline-responsive elements" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4347, or encoded by a nucleic acid molecule comprising the nucleic acid SEQ ID NO. 4346 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4346 or polypeptide SEQ ID NO. 4347, respectively is increased or generated or if the activity "golgi membrane exchange factor subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4362, or encoded by a nucleic acid molecule comprising the nucleic acid SEQ ID NO. 4361 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4361 or polypeptide SEQ ID NO. 4362, respectively is increased or generated or if the activity "dihydrosphingosine phosphate lyase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4403, or encoded by a nucleic acid molecule comprising the nucleic acid SEQ ID NO. 4402 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4402 or polypeptide SEQ ID NO. 4403, respectively is increased or generated or if the activity "ubiquitin regulatory protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4432, or encoded by a nucleic acid molecule comprising the nucleic acid SEQ ID NO. 4431 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4431 or polypeptide SEQ ID NO. 4432, respectively is increased or generated or if the activity "ydr355c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4436, or encoded by a nucleic acid molecule comprising the nucleic acid SEQ ID NO. 4435 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4435 or polypeptide SEQ ID NO. 4436, respectively is increased or generated or if the activity "lysine-specific metalloprotease" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4486, or encoded by a nucleic acid molecule comprising the nucleic acid SEQ ID NO. 4485 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4485 or polypeptide SEQ ID NO. 4486, respectively is increased or generated or if the activity "subunit of the transport protein particle (TRAPP) complex of the cis-Golgi" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4507, or encoded by a nucleic acid molecule comprising the nucleic acid SEQ ID NO. 4506 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4506 or polypeptide SEQ ID NO. 4507, respectively is increased or generated or if the activity "myo-inositol transporter" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4791, or encoded by a nucleic acid molecule comprising the nucleic acid SEQ ID NO. 4790 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4790 or polypeptide SEQ ID NO. 4791, respectively is increased or generated or if the activity "SM complex B protein for mRNA splicing" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4807, or encoded by a nucleic acid molecule comprising the nucleic acid SEQ ID NO. 4806 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4806 or polypeptide SEQ ID NO. 4807, respectively is increased or generated or if the activity "YFR007W-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 4837, or encoded by a nucleic acid molecule comprising the nucleic acid SEQ ID NO. 4836 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 4836 or polypeptide SEQ ID NO. 4837, respectively is increased or generated or if the activity "oxidoreductase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5312, or encoded by a nucleic acid molecule comprising the nucleic acid SEQ ID NO. 5311 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5311 or polypeptide SEQ ID NO. 5312, respectively is increased or generated or if the activity "transcription elongation factor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5347, or encoded by a nucleic acid molecule comprising the nucleic acid SEQ ID NO. 5346 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5346 or polypeptide SEQ ID NO. 5347, respectively is increased or generated or if the activity "cytosolic catalase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5534, or encoded by a nucleic acid molecule comprising the nucleic acid SEQ ID NO. 5533 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5533 or polypeptide SEQ ID NO. 5534, respectively is increased or generated or if the activity "ygr122c-a-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5552, or encoded by a nucleic acid molecule comprising the nucleic acid SEQ ID NO. 5551 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5551 or polypeptide SEQ ID NO. 5552, respectively is increased or generated or if the activity "v-SNARE binding protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5560, or encoded by a nucleic acid molecule comprising the nucleic acid SEQ ID NO. 5559 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5559 or polypeptide SEQ ID NO. 5560, respectively is increased or generated or if the activity "protein involved in sphingolipid biosynthesis" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5603, or encoded by a nucleic acid molecule comprising the nucleic acid SEQ ID NO. 5602 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5602 or polypeptide SEQ ID NO. 5603, respectively is increased or generated or if the activity "mitochondrial ribosomal protein of the small subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5609, or encoded by a nucleic acid molecule comprising the nucleic acid SEQ ID NO. 5608 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5608 or polypeptide SEQ ID NO. 5609, respectively is increased or generated or if the activity "phosphatidylserine decarboxylase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5615, or encoded by a nucleic acid molecule comprising the nucleic acid SEQ ID NO. 5614 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5614 or polypeptide SEQ ID NO. 5615, respectively is increased or generated or if the activity "cholinephosphate cytidylyltransferase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5667, or encoded by a nucleic acid molecule comprising the nucleic acid SEQ ID NO. 5666 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5666 or polypeptide SEQ ID NO. 5667, respectively is increased or generated or if the activity "ygr266w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5702, or encoded by a nucleic acid molecule comprising the nucleic acid SEQ ID NO. 5701 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5701 or polypeptide SEQ ID NO. 5702, respectively is increased or generated or if the activity "cell wall endo-beta-1,3-glucanase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5751, or encoded by a nucleic acid molecule comprising the nucleic acid SEQ ID NO. 5750 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5750 or polypeptide SEQ ID NO. 5751, respectively is increased or generated or if the activity "ygr290w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5755, or encoded by a nucleic acid molecule comprising the nucleic acid SEQ ID NO. 5754 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5754 or polypeptide SEQ ID NO. 5755, respectively is increased or generated or if the activity "yhl021c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5779, or encoded by a nucleic acid molecule comprising the nucleic acid SEQ ID NO. 5778 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5778 or polypeptide SEQ ID NO. 5779, respectively is increased or generated or if the activity "v-SNARE protein involved in Golgi transport" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5813, or encoded by a nucleic acid molecule comprising the nucleic acid SEQ ID NO. 5812 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5812 or polypeptide SEQ ID NO. 5813, respectively is increased or generated or if the activity "mitochondrial seryl-tRNA synthetase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5968, or encoded by a nucleic acid molecule comprising the nucleic acid SEQ ID NO. 5967 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5967 or polypeptide SEQ ID NO. 5968, respectively is increased or generated or if the activity "yhr127w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 5974, or encoded by a nucleic acid molecule comprising the nucleic acid SEQ ID NO. 5973 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 5973 or polypeptide SEQ ID NO. 5974, respectively is increased or generated or if the activity "aromatic amino acid aminotransferase II" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6028, or encoded by a nucleic acid molecule comprising the nucleic acid SEQ ID NO. 6027 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6027 or polypeptide SEQ ID NO. 6028, respectively is increased or generated or if the activity "glucoamylase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6108, or encoded by a nucleic acid molecule comprising the nucleic acid SEQ ID NO. 6107 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6107 or polypeptide SEQ ID NO. 6108, respectively is increased or generated or if the activity "histidine kinase osmosensor that regulates an osmosensing MAP kinase cascade" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6151, or encoded by a nucleic acid molecule comprising the nucleic acid SEQ ID NO. 6150 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6150 or polypeptide SEQ ID NO. 6151, respectively is increased or generated or if the activity "saccharopine dehydrogenase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6199, or encoded by a nucleic acid molecule comprising the nucleic acid SEQ ID NO. 6198 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6198 or polypeptide SEQ ID NO. 6199, respectively is increased or generated or if the activity "spindle checkpoint complex subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6209, or encoded by a nucleic acid molecule comprising the nucleic acid SEQ ID NO. 6208 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6208 or polypeptide SEQ ID NO. 6209, respectively is increased or generated or if the activity "nuclear pore complex subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6243, or encoded by a nucleic acid molecule comprising the nucleic acid SEQ ID NO. 6242 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6242 or polypeptide SEQ ID NO. 6243, respectively is increased or generated or if the activity "yjl064w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6247, or encoded by a nucleic acid molecule comprising the nucleic acid SEQ ID NO. 6246 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6246 or polypeptide SEQ ID NO. 6247, respectively is increased or generated or if the activity "yjl067w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6251, or encoded by a nucleic acid molecule comprising the nucleic acid SEQ ID NO. 6250 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6250 or polypeptide SEQ ID NO. 6251, respectively is increased or generated or if the activity "potassium:hydrogen antiporter" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6298, or encoded by a nucleic acid molecule comprising the nucleic acid SEQ ID NO. 6297 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6297 or polypeptide SEQ ID NO. 6298, respectively is increased or generated or if the activity "GPI-anchored cell wall protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6327, or encoded by a nucleic acid molecule comprising the nucleic acid SEQ ID NO. 6326 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6326 or polypeptide SEQ ID NO. 6327, respectively is increased or generated or if the activity "yjl213w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6489, or encoded by a nucleic acid molecule comprising the nucleic acid SEQ ID NO. 6488 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6488 or polypeptide SEQ ID NO. 6489, respectively is increased or generated or if the activity "peptidyl-prolyl cis-trans isomerase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6551, or encoded by a nucleic acid molecule comprising the nucleic acid SEQ ID NO. 6550 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6550 or polypeptide SEQ ID NO. 6551, respectively is increased or generated or if the activity "clathrin associated protein complex small subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6701, or encoded by a nucleic acid molecule comprising the nucleic acid SEQ ID NO. 6700 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6700 or polypeptide SEQ ID NO. 6701, respectively is increased or generated or if the activity "zinc metalloprotease" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 6817, or encoded by a nucleic acid molecule comprising the nucleic acid SEQ ID NO. 6816 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 6816 or polypeptide SEQ ID NO. 6817, respectively is increased or generated or if the activity "F1F0 ATP synthase beta subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7367, or encoded by a nucleic acid molecule comprising the nucleic acid SEQ ID NO. 7366 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7366 or polypeptide SEQ ID NO. 7367, respectively is increased or generated or if the activity "alpha-mannosidase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7476, or encoded by a nucleic acid molecule comprising the nucleic acid SEQ ID NO. 7475 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7475 or polypeptide SEQ ID NO. 7476, respectively is increased or generated or if the activity "ribosomal protein of the small subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7603, or encoded by a nucleic acid molecule comprising the nucleic acid SEQ ID NO. 7602 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7602 or polypeptide SEQ ID NO. 7603, respectively is increased or generated or if the activity "mitochondrial intermembrane space protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7652, or encoded by a nucleic acid molecule comprising the nucleic acid SEQ ID NO. 7651 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7651 or polypeptide SEQ ID NO. 7652, respectively is increased or generated or if the activity "phosphopantothenoylcysteine decarboxylase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7662, or encoded by a nucleic acid molecule comprising the nucleic acid SEQ ID NO. 7661 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7661 or polypeptide SEQ ID NO. 7662, respectively is increased or generated or if the activity "ykl100c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7676, or encoded by a nucleic acid molecule comprising the nucleic acid SEQ ID NO. 7675 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7675 or polypeptide SEQ ID NO. 7676, respectively is increased or generated or if the activity "ykl131w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7680, or encoded by a nucleic acid molecule comprising the nucleic acid SEQ ID NO. 7679 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7679 or polypeptide SEQ ID NO. 7680, respectively is increased or generated or if the activity "mitochondrial ribosomal protein of the large subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7711, or encoded by a nucleic acid molecule comprising the nucleic acid SEQ ID NO. 7710 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7710 or polypeptide SEQ ID NO. 7711, respectively is increased or generated or if the activity "G protein coupled pheromone receptor receptor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7736, or encoded by a nucleic acid molecule comprising the nucleic acid SEQ ID NO. 7735 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7735 or polypeptide SEQ ID NO. 7736, respectively is increased or generated or if the activity "golgi membrane protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7779, or encoded by a nucleic acid molecule comprising the nucleic acid SEQ ID NO. 7778 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7778 or polypeptide SEQ ID NO. 7779, respectively is increased or generated or if the activity "regulatory subunit of Glc7p type 1 protein serine-threonine phosphatase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 7830, or encoded by a nucleic acid molecule comprising the nucleic acid SEQ ID NO. 7829 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 7829 or polypeptide SEQ ID NO. 7830, respectively is increased or generated or if the activity "dihydroorotate dehydrogenase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8018, or encoded by a nucleic acid molecule comprising the nucleic acid SEQ ID NO. 8017 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8017 or polypeptide SEQ ID NO. 8018, respectively is increased or generated or if the activity "ykr016w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8046, or encoded by a nucleic acid molecule comprising the nucleic acid SEQ ID NO. 8045 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8045 or polypeptide SEQ ID NO. 8046, respectively is increased or generated or if the activity "ykr021w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8074, or encoded by a nucleic acid molecule comprising the nucleic acid SEQ ID NO. 8073 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8073 or polypeptide SEQ ID NO. 8074, respectively is increased or generated or if the activity "non-essential small GTPase of the Rho/Rac subfamily of Ras-like proteins" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8264, or encoded by a nucleic acid molecule comprising the nucleic acid SEQ ID NO. 8263 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8263 or polypeptide SEQ ID NO. 8264, respectively is increased or generated or if the activity "integral membrane protein localized to late Golgi vesicles" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8288, or encoded by a nucleic acid molecule comprising the nucleic acid SEQ ID NO. 8287 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8287 or polypeptide SEQ ID NO. 8288, respectively is increased or generated or if the activity "peptide transporter" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8469, or encoded by a nucleic acid molecule comprising the nucleic acid SEQ ID NO. 8468 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8468 or polypeptide SEQ ID NO. 8469, respectively is increased or generated or if the activity "transcription factor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8485, or encoded by a nucleic acid molecule comprising the nucleic acid SEQ ID NO. 8484 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8484 or polypeptide SEQ ID NO. 8485, respectively is increased or generated or if the activity "transmembrane protein with a role in cell wall polymer composition" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8493, or encoded by a nucleic acid molecule comprising the nucleic acid SEQ ID NO. 8492 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8492 or polypeptide SEQ ID NO. 8493, respectively is increased or generated or if the activity "yll014w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8515, or encoded by a nucleic acid molecule comprising the nucleic acid SEQ ID NO. 8514 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8514 or polypeptide SEQ ID NO. 8515, respectively is increased or generated or if the activity "non-essential Ras guanine nucleotide exchange factor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8540, or encoded by a nucleic acid molecule comprising the nucleic acid SEQ ID NO. 8539 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8539 or polypeptide SEQ ID NO. 8540, respectively is increased or generated or if the activity "yll023c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8572, or encoded by a nucleic acid molecule comprising the nucleic acid SEQ ID NO. 8571 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8571 or polypeptide SEQ ID NO. 8572, respectively is increased or generated or if the activity "yll037w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8576, or encoded by a nucleic acid molecule comprising the nucleic acid SEQ ID NO. 8575 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8575 or polypeptide SEQ ID NO. 8576, respectively is increased or generated or if the activity "yll049w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8580, or encoded by a nucleic acid molecule comprising the nucleic acid SEQ ID NO. 8579 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8579 or polypeptide SEQ ID NO. 8580, respectively is increased or generated or if the activity "cysteine transporter" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8662, or encoded by a nucleic acid molecule comprising the nucleic acid SEQ ID NO. 8661 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8661 or polypeptide SEQ ID NO. 8662, respectively is increased or generated or if the activity "metal ion transporter" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8992, or encoded by a nucleic acid molecule comprising the nucleic acid SEQ ID NO. 8991 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8991 or polypeptide SEQ ID NO. 8992, respectively is increased or generated or if the activity "ylr042c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 8996, or encoded by a nucleic acid molecule comprising the nucleic acid SEQ ID NO. 8995 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8995 or polypeptide SEQ ID NO.

8996, respectively is increased or generated or if the activity "YLR053c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 9000, or encoded by a nucleic acid molecule comprising the nucleic acid SEQ ID NO. 8999 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 8999 or polypeptide SEQ ID NO. 9000, respectively is increased or generated or if the activity "cytosolic serine hydroxymethyltransferase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 9552, or encoded by a nucleic acid molecule comprising the nucleic acid SEQ ID NO. 9551 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 9551 or polypeptide SEQ ID NO. 9552, respectively is increased or generated or if the activity "subunit of cytoplasmic phenylalanyl-tRNA synthetase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 9638, or encoded by a nucleic acid molecule comprising the nucleic acid SEQ ID NO. 9637 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 9637 or polypeptide SEQ ID NO. 9638, respectively is increased or generated or if the activity "ylr065c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 9673, or encoded by a nucleic acid molecule comprising the nucleic acid SEQ ID NO. 9672 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 9672 or polypeptide SEQ ID NO. 9673, respectively is increased or generated or if the activity "xylitol dehydrogenase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10183, or encoded by a nucleic acid molecule comprising the nucleic acid SEQ ID NO. 10182 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10182 or polypeptide SEQ ID NO. 10183, respectively is increased or generated or if the activity "3-keto sterol reductase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10215, or encoded by a nucleic acid molecule comprising the nucleic acid SEQ ID NO. 10214 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10214 or polypeptide SEQ ID NO. 10215, respectively is increased or generated or if the activity "alkyl hydroperoxide reductase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10448, or encoded by a nucleic acid molecule comprising the nucleic acid SEQ ID NO. 10447 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10447 or polypeptide SEQ ID NO. 10448, respectively is increased or generated or if the activity "ylr125w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10452, or encoded by a nucleic acid molecule comprising the nucleic acid SEQ ID NO. 10451 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10451 or polypeptide SEQ ID NO. 10452, respectively is increased or generated or if the activity "anaphase promoting complex (APC) subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10464, or encoded by a nucleic acid molecule comprising the nucleic acid SEQ ID NO. 10463 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10463 or polypeptide SEQ ID NO. 10464, respectively is increased or generated or if the activity "protein component of the large ribosomal subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10534, or encoded by a nucleic acid molecule comprising the nucleic acid SEQ ID NO. 10533 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10533 or polypeptide SEQ ID NO. 10534, respectively is increased or generated or if the activity "mitochondrial protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10542, or encoded by a nucleic acid molecule comprising the nucleic acid SEQ ID NO. 10541 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10541 or polypeptide SEQ ID NO. 10542, respectively is increased or generated or if the activity "ARV1 protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10563, or encoded by a nucleic acid molecule comprising the nucleic acid SEQ ID NO. 10562 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10562 or polypeptide SEQ ID NO. 10563, respectively is increased or generated or if the activity "GTP-binding protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10991, or encoded by a nucleic acid molecule comprising the nucleic acid SEQ ID NO. 10990 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10990 or polypeptide SEQ ID NO. 10991, respectively is increased or generated or if the activity "protein involved in shmoo formation and bipolar bud site selection" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 10999, or encoded by a nucleic acid molecule comprising the nucleic acid SEQ ID NO. 10998 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 10998 or polypeptide SEQ ID NO. 10999, respectively is increased or generated or if the activity "non-essential kinetochore protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11005, or encoded by a nucleic acid molecule comprising the nucleic acid SEQ ID NO. 11004 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11004 or polypeptide SEQ ID NO. 11005, respectively is increased or generated or if the activity "Meiotic recombination protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11013, or encoded by a nucleic acid molecule comprising the nucleic acid SEQ ID NO. 11012 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11012 or polypeptide SEQ ID NO. 11013, respectively is increased or generated or if the activity "signal transducing MEK kinase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11055, or encoded by a nucleic acid molecule comprising the nucleic acid SEQ ID NO. 11054 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11054 or polypeptide SEQ ID NO. 11055, respectively is increased or generated or if the activity "cytochrome c oxidase subunit VIII" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11067, or encoded by a nucleic acid molecule comprising the nucleic acid SEQ ID NO. 11066 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11066 or polypeptide SEQ ID NO. 11067, respectively is increased or generated or if the activity "ylr404w-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11075, or encoded by a nucleic acid molecule comprising the nucleic acid SEQ ID NO. 11074 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11074 or polypeptide SEQ ID NO. 11075, respectively is increased or generated or if the activity "ylr463c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11081, or encoded by a nucleic acid molecule comprising the nucleic acid SEQ ID NO. 11080 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11080 or polypeptide SEQ ID NO. 11081, respectively is increased or generated or if the activity "adenine phosphoribosyltransferase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11553, or encoded by a nucleic acid molecule comprising the nucleic acid SEQ ID NO. 11552 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11552 or polypeptide SEQ ID NO. 11553, respectively is increased or generated or if the activity "Mcm1p binding transcriptional repressor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11570, or encoded by a nucleic acid molecule comprising the nucleic acid SEQ ID NO. 11569 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11569 or polypeptide SEQ ID NO. 11570, respectively is increased or generated or if the activity "origin recognition complex subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11597, or encoded by a nucleic acid molecule comprising the nucleic acid SEQ ID NO. 11596 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11596 or polypeptide SEQ ID NO. 11597, respectively is increased or generated or if the activity "yml089c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11601, or encoded by a nucleic acid molecule comprising the nucleic acid SEQ ID NO. 11600 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11600 or polypeptide SEQ ID NO. 11601, respectively is increased or generated or if the activity "yml128c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 11613, or encoded by a nucleic acid molecule comprising the nucleic acid SEQ ID NO. 11612 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 11612 or polypeptide SEQ ID NO. 11613, respectively is increased or generated or if the activity "hexose transporter" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12247, or encoded by a nucleic acid molecule comprising the nucleic acid SEQ ID NO. 12246 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12246 or polypeptide SEQ ID NO. 12247, respectively is increased or generated or if the activity "Zinc finger protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12264, or encoded by a nucleic acid molecule comprising the nucleic acid SEQ ID NO. 12263 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12263 or polypeptide SEQ ID NO. 12264, respectively is increased or generated or if the activity "protein required for maturation of ribosomal RNAs" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12317, or encoded by a nucleic acid molecule comprising the nucleic acid SEQ ID NO. 12316 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12316 or polypeptide SEQ ID NO. 12317, respectively is increased or generated or if the activity "Factor arrest protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12328, or encoded by a nucleic acid molecule comprising the nucleic acid SEQ ID NO. 12327 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12327 or polypeptide SEQ ID NO. 12328, respectively is increased or generated or if the activity "YMR082C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12332, or encoded by a nucleic acid molecule comprising the nucleic acid SEQ ID NO. 12331 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12331 or polypeptide SEQ ID NO. 12332, respectively is increased or generated or if the activity "Nuclear cap-binding protein complex subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12379, or encoded by a nucleic acid molecule comprising the nucleic acid SEQ ID NO. 12378 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12378 or polypeptide SEQ ID NO. 12379, respectively is increased or generated or if the activity "YMR126C membrane protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12395, or encoded by a nucleic acid molecule comprising the nucleic acid SEQ ID NO. 12394 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12394 or polypeptide SEQ ID NO. 12395, respectively is increased or generated or if the activity "YMR144W-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12407, or encoded by a nucleic acid molecule comprising the nucleic acid SEQ ID NO. 12406 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12406 or polypeptide SEQ ID NO. 12407, respectively is increased or generated or if the activity "YMR160W-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12415, or encoded by a nucleic acid molecule comprising the nucleic acid SEQ ID NO. 12414 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12414 or polypeptide SEQ ID NO. 12415, respectively is increased or generated or if the activity "Stationary phase protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12421, or encoded by a nucleic acid molecule comprising the nucleic acid SEQ ID NO. 12420 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12420 or polypeptide SEQ ID NO. 12421, respectively is increased or generated or if the activity "YMR209C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12441, or encoded by a nucleic acid molecule comprising the nucleic acid SEQ ID NO. 12440 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12440 or polypeptide SEQ ID NO. 12441, respectively is increased or generated or if the activity "YMR233W-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12471, or encoded by a nucleic acid molecule comprising the nucleic acid SEQ ID NO. 12470 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12470 or polypeptide SEQ ID NO. 12471, respectively is increased or generated or if the activity "phosphoglucomutase/phosphomannomutase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12750, or encoded by a nucleic acid molecule comprising the nucleic acid SEQ ID NO. 12749 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12749 or polypeptide SEQ ID NO. 12750, respectively is increased or generated or if the activity "Regulatory CAT8 protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12774, or encoded by a nucleic acid molecule comprising the nucleic acid SEQ ID NO. 12773 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12773 or polypeptide SEQ ID NO. 12774, respectively is increased or generated or if the activity "translational elongation factor EF-3 (HEF3)" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12830, or encoded by a nucleic acid molecule comprising the nucleic acid SEQ ID NO. 12829 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12829 or polypeptide SEQ ID NO. 12830, respectively is increased or generated or if the activity "YNL320W-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12884, or encoded by a nucleic acid molecule comprising the nucleic acid SEQ ID NO. 12883 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12883 or polypeptide SEQ ID NO. 12884, respectively is increased or generated or if the activity "Chitin synthase 3 complex protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 12890, or encoded by a nucleic acid molecule comprising the nucleic acid SEQ ID NO. 12889 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 12889 or polypeptide SEQ ID NO. 12890, respectively is increased or generated or if the activity "Alkyl/aryl-sulfatase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 13015, or encoded by a nucleic acid molecule comprising the nucleic acid SEQ ID NO. 13014 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 13014 or polypeptide SEQ ID NO. 13015, respectively is increased or generated or if the activity "antiviral adaptor protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 13019, or encoded by a nucleic acid molecule comprising the nucleic acid SEQ ID NO. 13018 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 13018 or polypeptide SEQ ID NO. 13019, respectively is increased or generated or if the activity "repressor of G1 transcription" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 13025, or encoded by a nucleic acid molecule comprising the nucleic acid SEQ ID NO. 13024 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 13024 or polypeptide SEQ ID NO. 13025, respectively is increased or generated or if the activity "YOR097C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 13031, or encoded by a nucleic acid molecule comprising the nucleic acid SEQ ID NO. 13030 or a homolog of said nucleic acid molecule of an eukaryote or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 13030 or polypeptide SEQ ID NO. 13031, respectively is increased or generated or if the activity "Phosphoribosylaminoimidazole carboxylase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

In eukaryote the polypeptide is bifunctional and encoded by one nucleic acid molecule. Usually in prokaryote these two functions are encoded by two distinct nucleic acid molecules. The homologs of the respective nucleic acid molecules are listed in tables IA NHOM, IA CHOM, IIA NHOM and IIA CHOM (NHOM for the nucleic acid molecule encoding for the polypeptide covering the N-terminus and the polypeptide covering the N-terminus, respectively; CHOM for the nucleic acid molecule encoding for the polypeptide covering the C-terminus and the polypeptide covering the C-terminus, respectively). The co-expression and/or expression of a gene fusion of these homologs, which may be performed by methods known to a skilled person, give the same results as the expression of the eukaryotic homologs.

Accordingly, in one embodiment, in case the activity of a polypeptide according to the polypeptide SEQ ID NO. 14086, or encoded by a nucleic acid molecule comprising the nucleic acid SEQ ID NO. 14085 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14085 or polypeptide SEQ ID NO. 14086, respectively is increased or generated or if the activity "component of the RAM signaling network" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14094, or encoded by a nucleic acid molecule comprising the nucleic acid SEQ ID NO. 14093 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14093 or polypeptide SEQ ID NO. 14094, respectively is increased or generated or if the activity "protein kinase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14114, or encoded by a nucleic acid molecule comprising the nucleic acid SEQ ID NO. 14113 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14113 or polypeptide SEQ ID NO. 14114, respectively is increased or generated or if the activity "signal recognition particle subunit (SRP54)" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14247, or encoded by a nucleic acid molecule comprising the nucleic acid SEQ ID NO. 14246 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14246 or polypeptide SEQ ID NO. 14247, respectively is increased or generated or if the activity "regulatory subunit of the 26S proteasome" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14312, or encoded by a nucleic acid molecule comprising the nucleic acid SEQ ID NO. 14311 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14311 or polypeptide SEQ ID NO. 14312, respectively is increased or generated or if the activity "RNA polymerase III subunit" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14915, or encoded by a nucleic acid molecule comprising the nucleic acid SEQ ID NO. 14914 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14914 or polypeptide SEQ ID NO. 14915, respectively is increased or generated or if the activity "lysophospholipase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15383, or encoded by a nucleic acid molecule comprising the nucleic acid SEQ ID NO. 15382 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15382 or polypeptide SEQ ID NO. 15383, respectively is increased or generated or if the activity "saccharopine dehydrogenase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15461, or encoded by a nucleic acid molecule comprising the nucleic acid SEQ ID NO. 15460 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15460 or polypeptide SEQ ID NO. 15461, respectively is increased or generated or if the activity "alpha-mannosidase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15572, or encoded by a nucleic acid molecule comprising the nucleic acid SEQ ID NO. 15571 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15571 or polypeptide SEQ ID NO. 15572, respectively is increased or generated or if the activity "ykl100c-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15594, or encoded by a nucleic acid molecule comprising the nucleic acid SEQ ID NO. 15593 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15593 or polypeptide SEQ ID NO. 15594, respectively is increased or generated or if the activity "regulatory subunit of Glc7p type 1 protein serine-threonine phosphatase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15647, or encoded by a nucleic acid molecule comprising the nucleic acid SEQ ID NO. 15646 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15646 or polypeptide SEQ ID NO. 15647, respectively is increased or generated or if the activity "non-essential Ras guanine nucleotide exchange factor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15674, or encoded by a nucleic acid molecule comprising the nucleic acid SEQ ID NO. 15673 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15673 or polypeptide SEQ ID NO. 15674, respectively is increased or generated or if the activity "metal ion transporter" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16006, or encoded by a nucleic acid molecule comprising the nucleic acid SEQ ID NO. 16005 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16005 or polypeptide SEQ ID NO. 16006, respectively is increased or generated or if the activity "subunit of cytoplasmic phenylalanyl-tRNA synthetase" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16115, or encoded by a nucleic acid molecule comprising the nucleic acid SEQ ID NO. 16114 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16114 or polypeptide SEQ ID NO. 16115, respectively is increased or generated or if the activity "YMR082C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14403, or encoded by a nucleic acid molecule comprising the nucleic acid SEQ ID NO. 14402 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14402 or polypeptide SEQ ID NO.

14403, respectively is increased or generated or if the activity "B1258-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16094, or encoded by a nucleic acid molecule comprising the nucleic acid SEQ ID NO. 16093 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16093 or polypeptide SEQ ID NO. 16094, respectively is increased or generated or if the activity "YML101C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16107, or encoded by a nucleic acid molecule comprising the nucleic acid SEQ ID NO. 16106 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16106 or polypeptide SEQ ID NO. 16107, respectively is increased or generated or if the activity "nuclear fusion protein precursor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16121, or encoded by a nucleic acid molecule comprising the nucleic acid SEQ ID NO. 16120 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16120 or polypeptide SEQ ID NO. 16121, respectively is increased or generated or if the activity "inheritance of peroxisomes protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16276, or encoded by a nucleic acid molecule comprising the nucleic acid SEQ ID NO. 16275 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16275 or polypeptide SEQ ID NO. 16276, respectively is increased or generated or if the activity "exoribonuclease" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16306, or encoded by a nucleic acid molecule comprising the nucleic acid SEQ ID NO. 16305 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16305 or polypeptide SEQ ID NO. 16306, respectively is increased or generated or if the activity "iron sulfur cluster assembly protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16574, or encoded by a nucleic acid molecule comprising the nucleic acid SEQ ID NO. 16573 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16573 or polypeptide SEQ ID NO. 16574, respectively is increased or generated or if the activity "YPL068C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14397, or encoded by a nucleic acid molecule comprising the nucleic acid SEQ ID NO. 14396 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14396 or polypeptide SEQ ID NO. 14397, respectively is increased or generated or if the activity "B0165-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16300, or encoded by a nucleic acid molecule comprising the nucleic acid SEQ ID NO. 16299 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16299 or polypeptide SEQ ID NO. 16300, respectively is increased or generated or if the activity "YOR203W-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16134, or encoded by a nucleic acid molecule comprising the nucleic acid SEQ ID NO. 16133 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16133 or polypeptide SEQ ID NO. 16134, respectively is increased or generated or if the activity "ribonucleoprotein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15057, or encoded by a nucleic acid molecule comprising the nucleic acid SEQ ID NO. 15056 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15056 or polypeptide SEQ ID NO. 15057, respectively is increased or generated or if the activity "transcription factor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15588, or encoded by a nucleic acid molecule comprising the nucleic acid SEQ ID NO. 15587 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15587 or polypeptide SEQ ID NO. 15588, respectively is increased or generated or if the activity "YKL111C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16583, or encoded by a nucleic acid molecule comprising the nucleic acid SEQ ID NO. 16582 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16582 or polypeptide SEQ ID NO. 16583, respectively is increased or generated or if the activity "iron sulfur cluster assembly protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14840, or encoded by a nucleic acid molecule comprising the nucleic acid SEQ ID NO. 14839 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14839 or polypeptide SEQ ID NO. 14840, respectively is increased or generated or if the activity "transport protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15015, or encoded by a nucleic acid molecule comprising the nucleic acid SEQ ID NO. 15014 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15014 or polypeptide SEQ ID NO. 15015, respectively is increased or generated or if the activity "protein translocase protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15433, or encoded by a nucleic acid molecule comprising the nucleic acid SEQ ID NO. 15432 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15432 or polypeptide SEQ ID NO. 15433, respectively is increased or generated or if the activity "YJL010C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14498, or encoded by a nucleic acid molecule comprising the nucleic acid SEQ ID NO. 14497 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14497 or polypeptide SEQ ID NO. 14498, respectively is increased or generated or if the activity "B1267-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14719, or encoded by a nucleic acid molecule comprising the nucleic acid SEQ ID NO. 14718 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14718 or polypeptide SEQ ID NO. 14719, respectively is increased or generated or if the activity "membrane protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14792, or encoded by a nucleic acid molecule comprising the nucleic acid SEQ ID NO. 14791 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14791 or polypeptide SEQ ID NO. 14792, respectively is increased or generated or if the activity "B1381-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 14880, or encoded by a nucleic acid molecule comprising the nucleic acid SEQ ID NO. 14879 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 14879 or polypeptide SEQ ID NO. 14880, respectively is increased or generated or if the activity "B2646-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15065, or encoded by a nucleic acid molecule comprising the nucleic acid SEQ ID NO. 15064 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15064 or polypeptide SEQ ID NO. 15065, respectively is increased or generated or if the activity "60S ribosomal protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15258, or encoded by a nucleic acid molecule comprising the nucleic acid SEQ ID NO. 15257 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15257 or polypeptide SEQ ID NO. 15258, respectively is increased or generated or if the activity "Rho GDP-dissociation inhibitor" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 15379, or encoded by a nucleic acid molecule comprising the nucleic acid SEQ ID NO. 15378 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 15378 or polypeptide SEQ ID NO. 15379, respectively is increased or generated or if the activity "YHL005C-protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16630, or encoded by a nucleic acid molecule comprising the nucleic acid SEQ ID NO. 16629 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16629 or polypeptide SEQ ID NO. 16630, respectively is increased or generated or if the activity "transmembrane protein with a role in cell wall polymer composition" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

Accordingly, in one embodiment, in case the activity of a polypeptide according to the polypeptide SEQ ID NO. 16648, or encoded by a nucleic acid molecule comprising the nucleic acid SEQ ID NO. 16647 or a homolog of said nucleic acid molecule or polypeptide, e.g. if the activity of a nucleic acid molecule or a polypeptide comprising the nucleic acid or polypeptide or the consensus sequence or the polypeptide motif, as depicted in Table I, II or IV, application no. 1, column 7 in the respective same line as the nucleic acid molecule SEQ ID NO. 16647 or polypeptide SEQ ID NO. 16648, respectively is increased or generated or if the activity "Stationary phase protein" is increased or generated in an organism, an increased yield, preferably an enhanced NUE and/or an increased biomass production compared with the wild type control is conferred in said organism, especially an enhanced NUE, or an increased biomass production, or an enhanced NUE and an increased biomass production.

It was further observed that increasing or generating the activity of a nucleic acid molecule derived from the nucleic acid molecule shown in table VII-A in a plant, for example $A.$ $thaliana$, conferred increased nutrient use efficiency, e.g. an increased the nitrogen use efficiency, compared with the wild type control. Thus, in one embodiment, a nucleic acid molecule indicated in table VII-A or its homolog as indicated in table I or the expression product is used in the method of the present invention to increase nutrient use efficiency, e.g. to increase the nitrogen use efficiency, of a plant compared with the wild type control.

It was further observed that increasing or generating the activity of a nucleic acid molecule derived from the nucleic acid molecule shown in table VII-B in a plant, for example $A.$ $thaliana$, conferred increased stress tolerance, e.g. increased low temperature tolerance, compared with the wild type control. Thus, in one embodiment, a nucleic acid molecule indicated in table VII-B or its homolog as indicated in table I or the expression product is used in the method of the present invention to increase stress tolerance, e.g. increase low temperature tolerance, of a plant compared with the wild type control.

It was further observed that increasing or generating the activity of a nucleic acid molecule derived from the nucleic acid molecule shown in table VII-C in a plant, for example $A.$ $thaliana$, conferred increased stress tolerance, e.g. increased cycling drought tolerance, compared with the wild type control. Thus, in one embodiment, a nucleic acid molecule indicated in table VII-C or its homolog as indicated in table I or the expression product is used in the method of the present invention to increase stress tolerance, e.g. increase cycling drought tolerance, of a plant compared with the wild type control.

It was further observed that increasing or generating the activity of a nucleic acid molecule derived from the nucleic acid molecule shown in Table VII-D in a plant, for example $A.$ $thaliana$, conferred increase in intrinsic yield, e.g. increased biomass under standard conditions, e.g. increased biomass in the absence of stress conditions as well as in the absence of nutrient deficiency, compared with the wild type control. Thus, in one embodiment, a nucleic acid molecule indicated in table VII-D or its homolog as indicated in table I or the expression product is used in the method of the present invention to increase intrinsic yield, e.g. to increase yield, in the absence of stress conditions as well as in the absence of nutrient deficiency, of a plant compared with the wild type control.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissues organs or organelles or time periods.

In one embodiment, the process of the present invention comprises one or more of the following steps (a) stabilizing a protein conferring the increased expression of a protein encoded by the nucleic acid molecule of the invention or of the polypeptide of the invention having the herein-mentioned activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, 60165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidylprolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR2090-protein, YMR233W-protein, YNL320W-protein, YOR097C-protein, YOR203W-protein, YPL068C-protein, Zinc finger protein, and zinc metalloprotease and conferring an increased yield, especially an enhanced NUE and/or increased biomass production, as compared to a corresponding non-transformed wild type plant cell, plant or part thereof;

(b) stabilizing a mRNA conferring the increased expression of a protein encoded by the nucleic acid molecule of the invention or its homologs or of a mRNA encoding the polypeptide of the present invention having the hereinmentioned activity selected from the group consisting of 2-dehydro-3-deoxy-phosphoheptonate aldolase, 3-ketosterol reductase, 60S ribosomal protein, adenine phosphoribosyltransferase, adenylate kinase, alkyl hydroperoxide reductase, Alkyl/arylsulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endobeta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidylprolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209O-protein, YMR233W-protein, YNL320W-protein, YOR097C-protein, YOR203W-protein, YPL068C-protein, Zinc finger protein, and zinc metalloprotease and conferring an increased yield, especially an enhanced NUE and/or increased biomass production, as compared to a corresponding non-transformed wild type plant cell, plant or part thereof;

(c) increasing the specific activity of a protein conferring the increased expression of a protein encoded by the nucleic acid molecule of the invention or of the polypeptide of the present invention or decreasing the inhibitory regulation of the polypeptide of the invention;

(d) generating or increasing the expression of an endogenous or artificial transcription factor mediating the expression of a protein conferring the increased expression of a protein encoded by the nucleic acid molecule of the invention or of the polypeptide of the invention having the herein-mentioned activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidylprolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease and conferring an increased yield, especially an enhanced NUE and/or increased biomass production, as compared to a corresponding non-transformed wild type plant cell, plant or part thereof;

(e) stimulating activity of a protein conferring the increased expression of a protein encoded by the nucleic acid molecule of the present invention or a polypeptide of the present invention having the herein-mentioned activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/ aryl-sulfatase, alpha-glucosidase, alpha-mannosidase, anaphase promoting complex (APC) subunit, antiviral adapfor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidylprolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease and conferring an increased yield, especially an enhanced NUE and/or increased biomass production, as compared to a corresponding non-transformed wild type plant cell, plant or part thereof by adding one or more exogenous inducing factors to the organisms or parts thereof;

(f) expressing a transgenic gene encoding a protein conferring the increased expression of a polypeptide encoded by the nucleic acid molecule of the present invention or a polypeptide of the present invention, having the hereinmentioned activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR2090-protein, YMR233W-protein, YNL320W-protein, YOR097C-protein, YOR203W-protein, YPL068C-protein, Zinc finger protein, and zinc metalloprotease and conferring an increased yield, especially an enhanced NUE and/or increased biomass production, as compared to a corresponding non-transformed wild type plant cell, plant or part thereof; and/or (g) increasing the copy number of a gene conferring the increased expression of a nucleic acid molecule encoding a polypeptide encoded by the nucleic acid molecule of the invention or the polypeptide of the invention having the hereinmentioned activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydrolyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR2090-protein, YMR233W-protein, YNL320W-protein, YOR097C-protein, YOR203W-protein, YPL068C-protein, Zinc finger protein, and zinc metalloprotease and conferring an increased yield, especially an enhanced NUE and/or increased biomass production, as compared to a corresponding non-transformed wild type plant cell, plant or part thereof;

(h) increasing the expression of the endogenous gene encoding the polypeptide of the invention or its homologs by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements-positive elements can be randomly introduced in plants by T-DNA or transposon mutagenesis and lines can be identified in which the positive elements have been integrated near to a gene of the invention, the expression of which is thereby enhanced; and/or (i) modulating growth conditions of the plant in such a manner, that the expression or activity of the gene encoding the protein of the invention or the protein itself is enhanced;

(j) selecting of organisms with especially high activity of the proteins of the invention from natural or from mutagenized resources and breeding them into the target organisms, e.g. the elite crops.

Preferably, said mRNA is the nucleic acid molecule of the present invention and/or the protein conferring the increased expression of a protein encoded by the nucleic acid molecule of the present invention alone or linked to a transit nucleic acid sequence or transit peptide encoding nucleic acid sequence or the polypeptide having the herein mentioned activity, e.g. conferring an increased yield, especially an enhanced NUE and/or increased biomass production, as compared to a corresponding non-transformed wild type plant cell, plant or part thereof after increasing the expression or activity of the encoded polypeptide or having the activity of a polypeptide having an activity as the protein as shown in table II column 3 or its homologs.

In general, the amount of mRNA or polypeptide in a cell or a compartment of an organism correlates with the amount of encoded protein and thus with the overall activity of the encoded protein in said volume. Said correlation is not always linear, the activity in the volume is dependent on the stability of the molecules or the presence of activating or inhibiting co-factors. Further, product and educt inhibitions of enzymes are well known and described in textbooks, e.g. Stryer, Biochemistry.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren"/Enzyme inhibitors".

The activity of the abovementioned proteins and/or polypeptides encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic center of an polypeptide of the invention, e.g. as enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell or organelle of a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, especially a plant, a tissue, a cell or a cell compartment. "Increase" in the amount of a protein means the quantitative increase of the molecule number of said protein in an organism, especially a plant, a tissue, a cell or a cell compartment such as an organelle like a plastid or mitochondria or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase, can be caused by endogenous or exogenous factors. For example, an increase in activity in an organism or a part thereof can be caused by adding a gene product or a precursor or an activator or an agonist to the media or nutrition or can be caused by introducing said subjects into an organism, transient or stable. Furthermore such an increase can be reached by the introduction of the inventive nucleic acid sequence or the encoded protein in the correct cell compartment for example into the nucleus or cytoplasm respectively or into plastids either by transformation and/or targeting.

In one embodiment the increased yield level, especially the enhancement of the NUE and/or increased biomass production, as compared to a corresponding non-transformed wild type plant cell in the plant or a part thereof, e.g. in a cell, a tissue, a organ, an organelle, the cytosol etc., is achieved by increasing the endogenous level of the polypeptide of the invention. Accordingly, in an embodiment of the present invention, the present invention relates to a process wherein the gene copy number of a gene encoding the polynucleotide or nucleic acid molecule of the invention is increased. Further, the endogenous level of the polypeptide of the invention can for example be increased by modifying the transcriptional or translational regulation of the polypeptide.

In one embodiment an increased yield, especially the enhanced NUE and/or increased biomass production, of the plant or part thereof can be altered by targeted or random mutagenesis of the endogenous genes of the invention. For example homologous recombination can be used to either introduce positive regulatory elements like for plants the $^{35}$S enhancer into the promoter or to remove repressor elements form regulatory regions. In addition gene conversion like methods described by Kochevenko and Willmitzer (Plant Physiol. 132 (1), 174 (2003)) and citations therein can be used to disrupt repressor elements or to enhance to activity of positive regulatory elements.

Furthermore positive elements can be randomly introduced in (plant) genomes by TDNA or transposon mutagenesis and lines can be screened for, in which the positive elements have been integrated near to a gene of the invention, the expression of which is thereby enhanced. The activation of plant genes by random integrations of enhancer elements has been described by Hayashi et al. (Science 258, 1350 (1992)) or Weigel et al. (Plant Physiol. 122, 1003 (2000)) and others citied therein.

Reverse genetic strategies to identify insertions (which eventually carrying the activation elements) near in genes of interest have been described for various cases e.g. Krysan et al. (Plant Cell 11, 2283 (1999)); Sessions et al. (Plant Cell 14, 2985 (2002)); Young et al. (Plant Physiol. 125, 513 (2001)); Koprek et al. (Plant J. 24, 253 (2000)); Jeon et al. (Plant J. 22, 561 (2000)); Tissier et al. (Plant Cell 11, 1841 (1999)); Speulmann et al. (Plant Cell 11, 1853 (1999)). Briefly material from all plants of a large TDNA or transposon mutagenized plant population is harvested and genomic DNA prepared. Then the genomic DNA is pooled following specific architectures as described for example in Krysan et al. (Plant Cell 11, 2283 (1999)). Pools of genomics DNAs are then screened by specific multiplex PCR reactions detecting the combination of the insertional mutagen (e.g. T-DNA or Transposon) and the gene of interest. Therefore PCR reactions are run on the DNA pools with specific combinations of T-DNA or transposon border primers and gene specific primers. General rules for primer design can again be taken from Krysan et al. (Plant Cell 11, 2283 (1999)). Rescreening of lower levels DNA pools lead to the identification of individual plants in which the gene of interest is activated by the insertional mutagen.

The enhancement of positive regulatory elements or the disruption or weakening of negative regulatory elements can also be achieved through common mutagenesis techniques: The production of chemically or radiation mutated populations is a common technique and known to the skilled worker. Methods for plants are described by Koorneef et al. (Mutat Res. Mar. 93 (1) (1982)) and the citations therein and by Lightner and Caspar in "Methods in Molecular Biology" Vol. 82. These techniques usually induce point mutations that can be identified in any known gene using methods such as TILLING (Colbert et al., Plant Physiol, 126, (2001)).

Accordingly, the expression level can be increased if the endogenous genes encoding a polypeptide conferring an increased expression of the polypeptide of the present invention, in particular genes comprising the nucleic acid molecule of the present invention, are modified via homologous recombination, Tilling approaches or gene conversion. It also possible to add as mentioned herein targeting sequences to the inventive nucleic acid sequences.

Regulatory sequences, if desired, in addition to a target sequence or part thereof can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended. For example, the activation of plant genes by random integrations of enhancer elements has been described by Hayashi et al. (Science 258, 1350 (1992)) or Weigel et al. (Plant Physiol. 122, 1003 (2000)) and others citied therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of an artificial transcription factor as described in the examples. Alternative promoters, terminators and UTR are described below.

The activation of an endogenous polypeptide having above-mentioned activity, e.g. having the activity of a protein as shown in table II, application no. 1, column 3 or of the polypeptide of the invention, e.g. conferring the increased yield effect, especially the enhancement of NUE and/or increased biomass production, as compared to a corresponding non-transformed wild type plant cell, plant or part thereof after increase of expression or activity in the cytosol and/or in an organelle like a plastid, can also be increased by introducing a synthetic transcription factor, which binds close to the coding region of the gene encoding the protein as shown in table II, application no. 1, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, application no. 1, column 3. The expression of the chimeric transcription factor in a organism, in particular in a plant, leads to a specific expression of the protein as shown in table II, application no. 1, column 3. The methods thereto a known to a skilled person and/or disclosed e.g. in WO01/52620, Oriz, Proc. Natl. Acad. Sci. USA, 99, 13290 (2002) or Guan, Proc. Natl. Acad. Sci. USA 99, 13296 (2002).

In one further embodiment of the process according to the invention, organisms are used in which one of the abovementioned genes, or one of the above-mentioned nucleic acids, is mutated in a way that the activity of the encoded gene products is less influenced by cellular factors, or not at all, in comparison with the unmutated proteins. For example, well known regulation mechanism of enzymatic activity are substrate inhibition or feed back regulation mechanisms. Ways and techniques for the introduction of substitution, deletions and additions of one or more bases, nucleotides or amino acids of a corresponding sequence are described herein below in the corresponding paragraphs and the references listed there, e.g. in Sambrook et al., Molecular Cloning, Cold Spring Habour, NY, 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specific activity or an increased activity per volume, in particular per cell.

It can therefore be advantageous to express in an organism a nucleic acid molecule of the invention or a polypeptide of the invention derived from a evolutionary distantly related organism, as e.g. using a prokaryotic gene in a eukaryotic host, as in these cases the regulation mechanism of the host cell may not weaken the activity (cellular or specific) of the gene or its expression product.

The mutation is introduced in such a way that the enhanced yield, particularly due to one or more improved yield related traits as defined above, especially the enhanced NUE and/or biomass increase, are not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism. This leads to an enhanced NUE and/or increased biomass production as compared to a corresponding non-transformed wild type plant cell, plant or part thereof.

The invention provides that the above methods can be performed such that the tolerance to abiotic environmental stress is increased, wherein particularly the tolerance to low temperature and/or water use efficiency is increased. In another preferred embodiment the invention provides that the above methods can be performed such that the nutrient use efficiency, particularly the NUE is increased. In a further preferred embodiment the invention provides that the above methods can be performed such that the tolerance to abiotic stress, particularly the tolerance to low temperature and/or water use efficiency, and at the same time, the nutrient use efficiency, particularly the nitrogen use efficiency is increased. In another preferred embodiment the invention provides that the above methods can be performed such that the yield is increased in the absence of nutrient deficiencies as well as the absence of stress conditions. In a further preferred embodiment the invention provides that the above methods can be performed such that the nutrient use efficiency, particularly the nitrogen use efficiency, and the yield, in the absence of nutrient deficiencies as well as the absence of stress conditions, is increased. In a further preferred embodiment the invention provides that the above methods can be performed such that the tolerance to abiotic stress, particularly the tolerance to low temperature and/or water use efficiency, and at the same time, the nutrient use efficiency, particularly the nitrogen use efficiency, and the yield in the absence of nutrient deficiencies as well as the absence of stress conditions, is increased.

The invention is not limited to specific nucleic acids, specific polypeptides, specific cell types, specific host cells, specific conditions or specific methods etc. as such, but may vary and numerous modifications and variations therein will be apparent to those skilled in the art. It is also to be understood that the terminology used herein is for the purpose of describing specific embodiments only and is not intended to be limiting.

The present invention also relates to isolated nucleic acids comprising a nucleic acid molecule selected from the group consisting of:

(a) a nucleic acid molecule encoding the polypeptide shown in column 7 of table II B, application no. 1;

(b) a nucleic acid molecule shown in column 7 of table I B, application no. 1;

(c) a nucleic acid molecule, which, as a result of the degeneracy of the genetic code, can be derived from a polypeptide sequence depicted in column 5 or 7 of table II, application no. 1, and confers an increased yield, especially an enhanced NUE and/or increased biomass production, as compared to a corresponding non-transformed wild type plant cell, a plant or a part thereof;

(d) a nucleic acid molecule having at least 30% identity, preferably at least 40%, 50%, 60%, 70%, 75%, 80%, 85%, 90%, 95%, 96%, 97%, 98%, 99%, 99.5%, with the nucleic acid molecule sequence of a polynucleotide comprising the nucleic acid molecule shown in column 5 or 7 of table I, application no. 1, and confers an increased yield, especially an enhanced NUE and/or increased biomass production, as compared to a corresponding non-transformed wild type plant cell, a plant or a part thereof;

(e) a nucleic acid molecule encoding a polypeptide having at least 30% identity, preferably at least 40%, 50%, 60%, 70%, 75%, 80%, 85%, 90%, 95%, 96%, 97%, 98%, 99%, 99.5%, with the amino acid sequence of the polypeptide encoded by the nucleic acid molecule of (a), (b), (c) or (d) and having the activity represented by a nucleic acid molecule comprising a polynucleotide as depicted in column 5 of table I, application no. 1, and confers an increased yield, especially an enhanced NUE and/or increased biomass production, as compared to a corresponding non-transformed wild type plant cell, a plant or a part thereof;

(f) nucleic acid molecule which hybridizes with a nucleic acid molecule of (a), (b), (c), (d) or (e) under stringent hybridization conditions and confers an increased yield, especially an enhanced NUE and/or increased biomass production, as compared to a corresponding non-transformed wild type plant cell, a plant or a part thereof;

(g) a nucleic acid molecule encoding a polypeptide which can be isolated with the aid of monoclonal or polyclonal antibodies made against a polypeptide encoded by one of the nucleic acid molecules of (a), (b), (c), (d), (e) or (f) and having the activity represented by the nucleic acid molecule comprising a polynucleotide as depicted in column 5 of table I, application no. 1;

(h) a nucleic acid molecule encoding a polypeptide comprising the consensus sequence or one or more polypeptide motifs as shown in column 7 of table IV, application no. 1, and preferably having the activity represented by a protein molecule comprising a polypeptideas depicted in column 5 of table II or IV, application no. 1, (i) a nucleic acid molecule encoding a polypeptide having the activity represented by a protein as depicted in column 5 of table II, application no. 1, and confers an increased yield, especially an enhanced NUE and/or increased biomass production, as compared to a corresponding non-transformed wild type plant cell, a plant or a part thereof;

(j) nucleic acid molecule which comprises a polynucleotide, which is obtained by amplifying a cDNA library or a genomic library using the primers in column 7 of table III, application no. 1, (which in a special embodiment do not start at their 5'-end with the nucleotides ATA and) preferably having the activity represented by a protein molecule comprising a polypeptide as depicted in column 5 of table II or IV, application no. 1;

and (k) a nucleic acid molecule which is obtainable by screening a suitable nucleic acid library, especially a cDNA library and/or a genomic library, under stringent hybridization conditions with a probe comprising a complementary sequence of a nucleic acid molecule of (a) or (b) or with a fragment thereof, having at least 15 nt, preferably 20 nt, 30 nt, 50 nt, 100 nt, 200 nt, 500 nt, 750 nt or 1000 nt of a nucleic acid molecule complementary to a nucleic acid molecule sequence characterized in (a) to (e) and encoding a polypeptide having the activity represented by a protein comprising a polypeptide as depicted in column 5 of table II, application no. 1, whereby the nucleic acid molecule according to (a), (b), (c), (d), (e), (f), (g), (h), (i), (j) and (k) is at least in one or more nucleotides different from the sequence depicted in column 5 or 7 of table I A, application no. 1, and preferably which encodes a protein which differs at least in one or more amino acids from the protein sequences depicted in column 5 or 7 of table II A, application no. 1.

In one embodiment the invention relates to homologs of the aforementioned sequences, which can be isolated advantageously from yeast, fungi, ylruses, algae, bacteria, such as *Acetobacter* (subgen. *Acetobacter*) *aceti; Acidithiobacillus ferrooxidans; Acinetobacter* sp.; *Actinobacillus* sp; *Aeromonas salmonicida; Agrobacterium tumefaciens; Aquifex aeolicus*; *Arcanobacterium pyogenes*; Aster yellows phytoplasma; *Bacillus* sp.; *Bifidobacterium* sp.; *Borrelia burgdorferi; Brevibacterium* linens; *Brucella melitensis; Buchnera* sp.; Butyrivibrio fibrisolvens; *Campylobacter jejuni; Caulobacter crescentus; Chlamydia* sp.; *Chlamydophila* sp.; Chlorobium limicola; *Citrobacter* rodentium; *Clostridium* sp.; *Comamonas* testosteroni; *Corynebacterium* sp.; *Coxiella burnetii; Deinococcus radiodurans*; Dichelobacter nodosus; Edwardsiella ictaluri; *Enterobacter* sp.; *Erysipelothrix rhusiopathiae; Escherichia coli; Flavobacterium* sp.; *Francisella tularensis; Frankia* sp. Cp11; *Fusobacterium nucleatum*; Geobacillus stearothermophilus; Gluconobacter oxydans; *Haemophilus* sp.; *Helicobacter pylori; Klebsiella pneumoniae; Lactobacillus* sp.; *Lactococcus lactis; Listeria* sp.; *Mannheimia haemolytica; Mesorhizobium loti; Methylophaga thalassica; Microcystis aeruginosa; Microscilla* sp. PRE1; *Moraxella* sp. TA144; *Mycobacterium* sp.; *Mycoplasma* sp.; *Neisseria* sp.; *Nitrosomonas* sp.; *Nostoc* sp. PCC 7120; *Novosphingobium aromaticivorans; Oenococcus oeni; Pantoea citrea; Pasteurella multocida; Pediococcus pentosaceus; Phormidium foveolarum; Phytoplasma* sp.; *Plectonema boryanum; Prevotella ruminicola; Propionibacterium* sp.; *Proteus vulgaris; Pseudomonas* sp.; *Ralstonia* sp.; *Rhizobium* sp.; *Rhodococcus equi; Rhodothermus marinus; Rickettsia* sp.; *Riemerella anatipestifer; Ruminococcus flavefaciens; Salmonella* sp.; *Selenomonas ruminantium; Serratia entomophila; Shigella* sp.; *Sinorhizobium meliloti; Staphylococcus* sp.; *Streptococcus* sp.; *Streptomyces* sp.; *Synechococcus* sp.; *Synechocystis* sp. PCC 6803; *Thermotoga maritima; Treponema* sp.; *Ureaplasma urealyticum; Vibrio cholerae; Vibrio parahaemolyticus; Xylella fastidiosa; Yersinia* sp.; *Zymomonas mobilis*, preferably *Salmonella* sp. or *Escherichia coli* or plants, preferably from yeasts such as from the genera *Saccharomyces, Pichia, Candida, Hansenula, Torulopsis* or *Schizosaccharomyces* or plants such as *Arabidopsis thaliana*, maize, wheat, rye, oat, triticale, rice, barley, soybean, peanut, cotton, borage, sunflower, linseed, primrose, rapeseed, canola and turnip rape, manihot, pepper, sunflower, tagetes, solanaceous plant such as potato, tobacco, eggplant and tomato, *Vicia* species, pea, alfalfa, bushy plants such as coffee, cacao, tea, *Salix* species, trees such as oil palm, coconut, perennial grass, such as ryegrass and fescue, and forage crops, such as alfalfa and clover and from spruce, pine or fir for example. More preferably homologs of aforementioned sequences can be isolated from *Saccharomyces cerevisiae, E. coli* or *Synechocystis* sp. or plants, preferably *Brassica napus, Glycine max, Zea mays*, cotton or *Oryza sativa*.

The (NUE related) proteins (NUERPs) of the present invention are preferably produced by recombinant DNA techniques. For example, a nucleic acid molecule encoding the protein is cloned into an expression vector, for example in to a binary vector, the expression vector is introduced into a host cell, for example the *Arabidopsis thaliana* wild type NASC N906 or any other plant cell as described in the examples see below, and the NUE related protein is expressed in said host cell. Examples for binary vectors are pBIN19, pBI101, pBinAR, pGPTV, pCAMBIA, pBIB-HYG, pBecks, pGreen or pPZP (Hajukiewicz, P. et al., Plant Mol. Biol. 25, 989 (1994), and Hellens et al, Trends in Plant Science 5, 446 (2000)).

In one embodiment the (NUE related) protein (NUERP) of the present invention is preferably produced in a compartment of the cell, more preferably in the plastids. Ways of introducing nucleic acids into plastids and producing proteins in this compartment are known to the person skilled in the art have been also described in this application.

In another embodiment of the (NUE related) protein (NUERP) of the present invention is preferably produced in the cytosol of the cell. Ways of producing proteins in the cytosol are known to the person skilled in the art.

In another embodiment the protein of the present invention is preferably produced cytoplasmic, meaning without artificial targeting as defined in 0066.1.1.1. Ways of producing proteins without artificial targeting are known to the person skilled in the art.

Advantageously, the nucleic acid sequences according to the invention or the gene construct together with at least one reporter gene are cloned into an expression cassette, which is introduced into the organism via a vector or directly into the genome. This reporter gene should allow easy detection via a growth, fluorescence, chemical, bioluminescence or resistance assay or via a photometric measurement. Examples of reporter genes which may be mentioned are antibiotic- or herbicideresistance genes, hydrolase genes, fluorescence protein genes, bioluminescence genes, sugar or nucleotide metabolic genes or biosynthesis genes such as the Ura3 gene, the llv2 gene, the luciferase gene, the β-galactosidase gene, the gfp gene, the 2-desoxyglucose-6-phosphate phosphatase gene, the β-glucuronidase gene, β-lactamase gene, the neomycin phosphotransferase gene, the hygromycin phosphotransferase gene, a mutated acetohydroxyacid synthase (AHAS) gene (also known as acetolactate synthase (ALS) gene), a gene for a D-amino acid metabolizing enzmye or the BASTA (=gluphosinate-resistance) gene. These genes permit easy measurement and quantification of the transcription activity and hence of the expression of the genes. In this way genome positions may be identified which exhibit differing productivity.

In a preferred embodiment a nucleic acid construct, for example an expression cassette, comprises upstream, i.e. at the 5' end of the encoding sequence, a promoter and downstream, i.e. at the 3' end, a polyadenylation signal and optionally other regulatory elements which are operably linked to the intervening encoding sequence with one of the nucleic acids of SEQ ID NO as depicted in table I, application no. 1, column 5 and 7. By an operable linkage is meant the sequential arrangement of promoter, encoding sequence, terminator and optionally other regulatory elements in such a way that each of the regulatory elements can fulfill its function in the expression of the encoding sequence in due manner. In one embodiment the sequences preferred for operable linkage are targeting sequences for ensuring subcellular localization in plastids. However, targeting sequences for ensuring subcellular localization in the mitochondrium, in the endoplasmic reticulum (=ER), in the nucleus, in oil corpuscles or other compartments may also be employed as well as translation promoters such as the 5' lead sequence in tobacco mosaic virus (Gallie et al., Nucl. Acids Res. 15 8693 (1987)).

A nucleic acid construct, for example an expression cassette may, for example, contain a constitutive promoter or a tissue-specific promoter (preferably the USP or napin promoter) the gene to be expressed and the ER retention signal. For the ER retention signal the KDEL amino acid sequence (lysine, aspartic acid, glutamic acid, leucine) or the KKX amino acid sequence (lysine-lysine-X-stop, wherein X means every other known amino acid) is preferably employed.

For expression in a host organism, for example a plant, the expression cassette is advantageously inserted into a vector such as by way of example a plasmid, a phage or other DNA which allows optimal expression of the genes in the host organism. Examples of suitable plasmids are: in *E. coli* pLG338, pACYC184, pBR series such as e.g. pBR322, pUC series such as pUC18 or pUC19, M113 mp series, pKC30, pRep4, pHS1, pHS2, pPLc236, pMBL24, pLG200, pUR290, pIN-III[113]-B1, λgt11 or pBdCl; in *Streptomyces* pIJ101, pIJ364, pIJ702 or pIJ361; in *Bacillus* pUB110, pC194 or pBD214; in *Corynebacterium* pSA77 or pAJ667; in fungi pALS1, pIL2 or pBB116; other advantageous fungal vectors are described by Romanos M. A. et al., Yeast 8, 423 (1992) and by van den Hondel, C. A. M. J. J. et al. [(1991) "Heterologous gene expression in filamentous fungi"] as well as in "More Gene Manipulations" in "Fungi" in Bennet J. W. & Lasure L. L., eds., pp. 396-428, Academic Press, San Diego, and in "Gene transfer systems and vector development for filamentous fungi" [van den Hondel, C. A. M. J. J. & Punt, P. J. (1991) in: Applied Molecular Genetics of Fungi, Peberdy, J. F. et al., eds., pp. 1-28, Cambridge University Press: Cambridge]. Examples of advantageous yeast promoters are 2 μM, pAG-1, YEp6, YEp13 or pEMBLYe23. Examples of algal or plant promoters are pLGV23, pGHlac⁺, pBIN19, pAK2004, pVKH or pDH51 (see Schmidt, R. and Willmitzer, L., Plant Cell Rep. 7, 583 (1988))). The vectors identified above or derivatives of the vectors identified above are a small selection of the possible plasmids. Further plasmids are well known to those skilled in the art and may be found, for example, in "Cloning Vectors" (Eds. Pouwels P. H. et al. Elsevier, Amsterdam-New York-Oxford, 1985, ISBN 0 444 904018). Suitable plant vectors are described inter alia in "Methods in Plant Molecular Biology and Biotechnology" (CRC Press, Ch. 6/7, pp. 71-119). Advantageous vectors are known as shuttle vectors or binary vectors which replicate in *E. coli* and *Agrobacterium*.

By vectors is meant with the exception of plasmids all other vectors known to those skilled in the art such as by way of example phages, viruses such as SV40, CMV, baculovirus, adenovirus, transposons, IS elements, phasmids, phagemids, cosmids, linear or circular DNA. These vectors can be replicated autonomously in the host organism or be chromosomally replicated, chromosomal replication being preferred.

In a further embodiment of the vector the expression cassette according to the invention may also advantageously be introduced into the organisms in the form of a linear DNA and be integrated into the genome of the host organism by way of heterologous or homologous recombination. This linear DNA may be composed of a linearized plasmid or only of the expression cassette as vector or the nucleic acid sequences according to the invention.

In a further advantageous embodiment the nucleic acid sequence according to the invention can also be introduced into an organism on its own.

If in addition to the nucleic acid sequence according to the invention further genes are to be introduced into the organism, all together with a reporter gene in a single vector or each single gene with a reporter gene in a vector in each case can be introduced into the organism, whereby the different vectors can be introduced simultaneously or successively.

The vector advantageously contains at least one copy of the nucleic acid sequences according to the invention and/or the expression cassette (=gene construct) according to the invention.

The invention further provides an isolated recombinant expression vector comprising a nucleic acid encoding a polypeptide as depicted in table II, application no. 1, column 5 or 7, wherein expression of the vector in a host cell results in increased yield, especially in enhanced NUE and/or biomass production, as compared to a wild type variety of the host cell.

As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g. bacterial vectors having a bacterial origin of replication and episomal mammalian vectors). Other vectors (e.g. non-episomal mammalian vectors) are integrated into the genome of a host cell or an organelle upon introduction into the host cell, and thereby are replicated along with the host or organelle genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. As used herein with respect to a recombinant expression vector, "operatively linked" is intended to mean that the nucleotide sequence of interest is linked to the regulatory sequence(s) in a manner which allows for expression of the nucleotide sequence (e.g. in an in vitro transcription/translation system or in a host cell when the vector is introduced into the host cell). The term "regulatory sequence" is intended to include promoters, enhancers, and other expression control elements (e.g. polyadenylation signals). Such regulatory sequences are described, for example, in Goeddel, Gene Expression Technology: Methods in Enzymology 185, Academic Press, San Diego, Calif. (1990), and Gruber and Crosby, in: Methods in Plant Molecular Biology and Biotechnology, eds. Glick and Thompson, Chapter 7, 89-108, CRC Press; Boca Raton, Fla., including the references therein. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., NUERPs, mutant forms of NUERPs, fusion polypeptides, etc.).

The recombinant expression vectors of the invention can be designed for expression of the polypeptide of the invention in plant cells. For example, NUERP genes can be expressed in plant cells (see Schmidt R., and Willmitzer L., Plant Cell Rep. 7 (1988); Plant Molecular Biology and Biotechnology, C Press, Boca Raton, Fla., Chapter 6/7, p. 71-119 (1993); White F. F., Jenes B. et al., Techniques for Gene Transfer, in: Transgenic Plants, Vol. 1, Engineering and Utilization, eds. Kung and Wu R., 128-43, Academic Press: 1993; Potrykus, Annu. Rev. Plant Physiol. Plant Molec. Biol. 42, 205 (1991) and references cited therein). Suitable host cells are discussed further in Goeddel, Gene Expression Technology: Methods in Enzymology 185, Academic Press: San Diego, Calif. (1990). Alternatively, the recombinant expression vector can be transcribed and translated in vitro, for example using T7 promoter regulatory sequences and T7 polymerase.

Expression of polypeptides in prokaryotes is most often carried out with vectors containing constitutive or inducible promoters directing the expression of either fusion or nonfusion polypeptides. Fusion vectors add a number of amino acids to a polypeptide encoded therein, usually to the amino terminus of the recombinant polypeptide but also to the C-terminus or fused within suitable regions in the polypeptides. Such fusion vectors typically serve three purposes: 1) to increase expression of a recombinant polypeptide; 2) to increase the solubility of a recombinant polypeptide; and 3) to aid in the purification of a recombinant polypeptide by acting as a ligand in affinity purification. Often, in fusion expression vectors, a proteolytic cleavage site is introduced at the junction of the fusion moiety and the recombinant polypeptide to enable separation of the recombinant polypeptide from the fusion moiety subsequent to purification of the fusion polypeptide. Such enzymes, and their cognate recognition sequences, include Factor Xa, thrombin, and enterokinase.

By way of example the plant expression cassette can be installed in the pRT transformation vector ((a) Toepfer et al., Methods Enzymol. 217, 66 (1993), (b) Toepfer et al., Nucl. Acids. Res. 15, 5890 (1987)).

Alternatively, a recombinant vector (=expression vector) can also be transcribed and translated in vitro, e.g. by using the T7 promoter and the T7 RNA polymerase.

Expression vectors employed in prokaryotes frequently make use of inducible systems with and without fusion proteins or fusion oligopeptides, wherein these fusions can ensue in both N-terminal and C-terminal manner or in other useful domains of a protein. Such fusion vectors usually have the following purposes: 1) to increase the RNA expression rate; 2) to increase the achievable protein synthesis rate; 3) to increase the solubility of the protein; 4) or to simplify purification by means of a binding sequence usable for affinity chromatography. Proteolytic cleavage points are also frequently introduced via fusion proteins, which allow cleavage of a portion of the fusion protein and purification. Such recognition sequences for proteases are recognized, e.g. factor Xa, thrombin and enterokinase.

Typical advantageous fusion and expression vectors are pGEX (Pharmacia Biotech Inc; Smith D. B. and Johnson K. S., Gene 67, 31 (1988)), pMAL (New England Biolabs, Beverly, Mass.) and pRIT5 (Pharmacia, Piscataway, N.J.) which contains glutathione S-transferase (GST), maltose binding protein or protein A.

In one embodiment, the coding sequence of the polypeptide of the invention is cloned into a pGEX expression vector to create a vector encoding a fusion polypeptide comprising, from the N-terminus to the C-terminus, GST-thrombin cleavage site-X polypeptide. The fusion polypeptide can be purified by affinity chromatography using glutathione-agarose resin. Recombinant PKNUERP unfused to GST can be recovered by cleavage of the fusion polypeptide with thrombin.

Other examples of E. coli expression vectors are pTrc (Amann et al., Gene 69, 301 (1988)) and pET vectors (Studier et al., Gene Expression Technology: Methods in Enzymology 185, Academic Press, San Diego, Calif. (1990) 60-89; Stratagene, Amsterdam, The Netherlands).

Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (T7 gni). This viral polymerase is supplied by host strains BL21(DE3) or HMS174(DE3) from a resident I prophage harboring a T7 gn1 gene under the transcriptional control of the lacUV 5 promoter.

In a preferred embodiment of the present invention, the NUERPs are expressed in plants and plants cells such as unicellular plant cells (e.g. algae) (see Falciatore et al., Marine Biotechnology 1 (3), 239 (1999) and references therein) and plant cells from higher plants (e.g., the spermatophytes, such as crop plants). A nucleic acid molecule coding for NUERP as depicted in table II, application no. 1, column 5 or 7 may be "introduced" into a plant cell by any means, including transfection, transformation or transduction, electroporation, particle bombardment, agroinfection, and the like. One transformation method known to those of skill in the art is the dipping of a flowering plant into an *Agrobacteria* solution, wherein the *Agrobacteria* contains the nucleic acid of the invention, followed by breeding of the transformed gametes.

Other suitable methods for transforming or transfecting host cells including plant cells can be found in Sambrook et al., Molecular Cloning: A Laboratory Manual. $2^{nd}$, ed., Cold Spring Harbor Laboratory, Cold Spring Harbor Laboratory Press, Cold Spring Harbor, N.Y., 1989, and other laboratory manuals such as Methods in Molecular Biology, 1995, Vol. 44, *Agrobacterium* protocols, ed: Gartland and Davey, Humana Press, Totowa, N.J. As increased NUE and/or biomass production is a general trait wished to be inherited into a wide variety of plants like maize, wheat, rye, oat, triticale, rice, barley, soybean, peanut, cotton, rapeseed and canola, manihot, pepper, sunflower and tagetes, solanaceous plants like potato, tobacco, eggplant, and tomato, *Vicia* species, pea, alfalfa, bushy plants (coffee, cacao, tea), *Salix* species, trees (oil palm, coconut), perennial grasses, and forage crops, these crop plants are also preferred target plants for a genetic engineering as one further embodiment of the present invention. Forage crops include, but are not limited to Wheatgrass, Canarygrass, Bromegrass, Wildrye Grass, Bluegrass, Orchardgrass, Alfalfa, Salfoin, Birdsfoot Trefoil, Alsike Clover, Red Clover and Sweet Clover.

In one embodiment of the present invention, transfection of a nucleic acid molecule coding for NUERP as depicted in table II, application no. 1, column 5 or 7 into a plant is achieved by *Agrobacterium* mediated gene transfer. *Agrobacterium* mediated plant transformation can be performed using for example the GV3101(pMP90) (Koncz and Schell, Mol. Gen. Genet. 204, 383 (1986)) or LBA4404

(Clontech) *Agrobacterium tumefaciens* strain. Transformation can be performed by standard transformation and regeneration techniques (Deblaere et al., Nucl. Acids Res. 13, 4777 (1994), Gelvin, Stanton B. and Schilperoort Robert A, Plant Molecular Biology Manual, $2^{nd}$ Ed.-Dordrecht: Kluwer Academic Publ., 1995.-in Sect., Ringbuc Zentrale Signatur: BT11-P ISBN 0-7923-2731-4; Glick Bernard R., Thompson John E., Methods in Plant Molecular Biology and Biotechnology, Boca Raton: CRC Press, 1993 360S., ISBN 0-8493-5164-2). For example, rapeseed can be transformed via cotyledon or hypocotyl transformation (Moloney et al., Plant Cell Report 8, 238 (1989); De Block et al., Plant Physiol. 91, 694 (1989)). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., Plant Cell Report 13, 282 (1994). Additionally, transformation of soybean can be performed using for example a technique described in European Patent No. 424 047, U.S. Pat. No. 5,322,783, European Patent No. 397 687, U.S. Pat. No. 5,376,543 or U.S. Pat. No. 5,169,770. Transformation of maize can be achieved by particle bombardment, polyethylene glycol mediated DNA uptake or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

According to the present invention, the introduced nucleic acid molecule coding for NUERP as depicted in table II, application no. 1, column 5 or 7 may be maintained in the plant cell stably if it is incorporated into a non-chromosomal autonomous replicon or integrated into the plant chromosomes or organelle genome. Alternatively, the introduced NUERP may be present on an extra-chromosomal non-replicating vector and be transiently expressed or transiently active.

In one embodiment, a homologous recombinant microorganism can be created wherein the NUERP is integrated into a chromosome, a vector is prepared which contains at least a portion of a nucleic acid molecule coding for NUERP as depicted in table II, application no. 1, column 5 or 7 into which a deletion, addition, or substitution has been introduced to thereby alter, e.g., functionally disrupt, the NUERP gene. Preferably, the NUERP gene is a yeast, *E. coli* gene, but it can be a homolog from a related plant or even from a mammalian or insect source. The vector can be designed such that, upon homologous recombination, the endogenous nucleic acid molecule coding for NUERP as depicted in table II, application no. 1, column 5 or 7 is mutated or otherwise altered but still encodes a functional polypeptide (e.g., the upstream regulatory region can be altered to thereby alter the expression of the endogenous NUERP). In a preferred embodiment the biological activity of the protein of the invention is increased upon homologous recombination. To create a point mutation via homologous recombination, DNA-RNA hybrids can be used in a technique known as chimeraplasty (Cole-Strauss et al., Nucleic Acids Research 27 (5), 1323 (1999) and Kmiec, Gene Therapy American Scientist. 87 (3), 240 (1999)). Homologous recombination procedures in *Physcomitrella patens* are also well known in the art and are contemplated for use herein.

Whereas in the homologous recombination vector, the altered portion of the nucleic acid molecule coding for NUERP as depicted in table II, application no. 1, column 5 or 7 is flanked at its 5' and 3' ends by an additional nucleic acid molecule of the NUERP gene to allow for homologous recombination to occur between the exogenous NUERP gene carried by the vector and an endogenous NUERP gene, in a microorganism or plant. The additional flanking NUERP nucleic acid molecule is of sufficient length for successful homologous recombination with the endogenous gene. Typically, several hundreds of base pairs up to kilobases of flanking DNA (both at the 5' and 3' ends) are included in the vector. See, e.g., Thomas K. R., and Capecchi M. R., Cell 51, 503 (1987) for a description of homologous recombination vectors or Strepp et al., PNAS, 95 (8), 4368 (1998) for cDNA based recombination in *Physcomitrella patens*. The vector is introduced into a microorganism or plant cell (e.g. via polyethylene glycol mediated DNA), and cells in which the introduced NUERP gene has homologously recombined with the endogenous NUERP gene are selected using art-known techniques.

Whether present in an extra-chromosomal non-replicating vector or a vector that is integrated into a chromosome, the nucleic acid molecule coding for NUERP as depicted in table II, application no. 1, column 5 or 7 preferably resides in a plant expression cassette. A plant expression cassette preferably contains regulatory sequences capable of driving gene expression in plant cells that are operatively linked so that each sequence can fulfill its function, for example, termination of transcription by polyadenylation signals. Preferred polyadenylation signals are those originating from *Agrobacterium tumefaciens* t-DNA such as the gene 3 known as octopine synthase of the Ti-plasmid pTiACH5 (Gielen et al., EMBO J. 3, 835 (1984)) or functional equivalents thereof but also all other terminators functionally active in plants are suitable. As plant gene expression is very often not limited on transcriptional levels, a plant expression cassette preferably contains other operatively linked sequences like translational enhancers such as the overdrive-sequence containing the 5"-untranslated leader sequence from tobacco mosaic virus enhancing the polypeptide per RNA ratio (Gallie et al., Nucl. Acids Research 15, 8693 (1987)). Examples of plant expression vectors include those detailed in: Becker D. et al., Plant Mol. Biol. 20, 1195 (1992); and Bevan M. W., Nucl. Acid. Res. 12, 8711 (1984); and "Vectors for Gene Transfer in Higher Plants" in: Transgenic Plants, Vol. 1, Engineering and Utilization, eds. Kung and Wu R., Academic Press, 1993, S. 15-38.

"Transformation" is defined herein as a process for introducing heterologous DNA into a plant cell, plant tissue, or plant. It may occur under natural or artificial conditions using various methods well known in the art. Transformation may rely on any known method for the insertion of foreign nucleic acid sequences into aprokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time. Transformed plant cells, plant tissue, or plants are understood to encompass not only the end product of a transformation process, but also transgenic progeny thereof.

The terms "transformed," "transgenic," and "recombinant" refer to a host organism such as a bacterium or a plant into which a heterologous nucleic acid molecule has been introduced. The nucleic acid molecule can be stably integrated into the genome of the host or the nucleic acid molecule can also be present as an extrachromosomal molecule. Such an extrachromosomal molecule can be auto-replicating. Transformed cells, tissues, or plants are understood to encompass not only the end product of a transformation process, but also transgenic progeny thereof. A "non-transformed", "non-transgenic" or "non-recombinant" host refers to a wild-type organism, e.g. a bacterium or plant, which does not contain the heterologous nucleic acid molecule.

A "transgenic plant", as used herein, refers to a plant which contains a foreign nucleotide sequence inserted into either its nuclear genome or organellar genome. It encompasses further the offspring generations i.e. the T1-, T2- and consecutively generations or BC1-, BC2- and consecutively generation as well as crossbreeds thereof with non-transgenic or other transgenic plants.

The host organism (=transgenic organism) advantageously contains at least one copy of the nucleic acid according to the invention and/or of the nucleic acid construct according to the invention.

In principle all plants can be used as host organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassaya, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

In one embodiment of the invention transgenic plants are selected from the group comprising cereals, soybean, rapeseed (including oil seed rape, especially canola and winter oil seed rape), cotton sugarcane and potato, especially corn, soy, rapeseed (including oil seed rape, especially canola and winter oil seed rape), cotton, wheat and rice.

In another embodiment of the invention the transgenic plant is a gymnosperm plant, especially a spruce, pine or fir.

In one preferred embodiment, the host plant is selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa* paradisiaca, Musa spp., Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon Hordeum aegiceras, Hordeum hexastichon., Hordeum hexastichum, Hordeum irregulare, Hordeum sativum, Hordeum secalinum, Avena sativa, Avena fatua, Avena byzantina, Avena fatua var. sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum or Triticum vulgare, Cofea spp., Coffea arabica, Coffea canephora, Coffea liberica, Capsicum annuum, Capsicum annuum var. glabriusculum, Capsicum frutescens, Capsicum annuum, Nicotiana tabacum, Solanum tuberosum, Solanum melongena, Lycopersicon esculentum, Lycopersicon lycopersicum., Lycopersicon pyriforme, Solanum integrifolium, Solanum lycopersicum Theobroma cacao or Camellia sinensis. Anacardiaceae such as the genera Pistacia, Mangifera, Anacardium e.g. the species Pistacia vera [pistachios, Pistazie], Mangifer indica [Mango] or Anacardium occidentale [Cashew]; Asteraceae such as the genera Calendula, Carthamus, Centaurea, Cichorium, Cynara, Helianthus, Lactuca, Locusta, Tagetes, Valeriana e.g. the species Calendula officinalis [Marigold], Carthamus tinctorius [safflower], Centaurea cyanus [cornflower], Cichorium intybus [blue daisy], Cynara scolymus [Artichoke], Helianthus annus [sunflower], Lactuca sativa, Lactuca crispa, Lactuca esculenta, Lactuca scariola L. ssp. sativa, Lactuca scariola L. var. integrate, Lactuca scariola L. var. integrifolia, Lactuca sativa subsp. romana, Locusta communis, Valeriana locusta [lettuce], Tagetes lucida, Tagetes erecta or Tagetes tenuifolia [Marigold]; Apiaceae such as the genera Daucus e.g. the species Daucus carota [carrot]; Betulaceae such as the genera Corylus e.g. the species Corylus avellana or Corylus colurna [hazelnut]; Boraginaceae such as the genera Borago e.g. the species Borago officinalis [borage]; Brassicaceae such as the genera Brassica, Melanosinapis, Sinapis, Arabadopsis e.g. the species Brassica napus, Brassica rapa ssp. [canola, oilseed rape, turnip rape], Sinapis arvensis Brassica juncea, Brassica juncea var. juncea, Brassica juncea var. crispifolia, Brassica juncea var. foliosa, Brassica nigra, Brassica sinapioides, Melanosinapis communis [mustard], Brassica oleracea [fodder beet] or Arabidopsis thaliana; Bromeliaceae such as the genera Anana, Bromelia e.g. the species Anana comosus, Ananas ananas or Bromelia comosa [pineapple]; Caricaceae such as the genera Carica e.g. the species Carica papaya [papaya]; Cannabaceae such as the genera Cannabis e.g. the species Cannabis sative [hemp], Convolvulaceae such as the genera Ipomea, Convolvulus e.g. the species Ipomoea batatus, Ipomoea pandurata, Convolvulus batatas, Convolvulus tiliaceus, Ipomoea fastigiata, Ipomoea tiliacea, Ipomoea triloba or Convolvulus panduratus [sweet potato, Man of the Earth, wild potato], Chenopodiaceae such as the genera Beta, i.e. the species Beta vulgaris, Beta vulgaris var. altissima, Beta vulgaris var. Vulgaris, Beta maritima, Beta vulgaris var. perennis, Beta vulgaris var. conditiva or Beta vulgaris var. esculenta [sugar beet]; Cucurbitaceae such as the genera Cucubita e.g. the species Cucurbita maxima, Cucurbita mixta, Cucurbita pepo or Cucurbita moschata [pumpkin, squash]; Elaeagnaceae such as the genera Elaeagnus e.g. the species Olea europaea [olive]; Ericaceae such as the genera Kalmia e.g. the species Kalmia latifolia, Kalmia angustifolia, Kalmia microphylla, Kalmia polifolia, Kalmia occidentalis, Cistus chamaerhodendros or Kalmia lucida [American laurel, broad-leafed laurel, calico bush, spoon wood, sheep laurel, alpine laurel, bog laurel, western bog-laurel, swamp-laurel]; Euphorbiaceae such as the genera Manihot, Janipha, Jatropha, Ricinus e.g. the species Manihot utilissima, Janipha manihot, Jatropha manihot., Manihot aipil, Manihot dulcis, Manihot manihot, Manihot melanobasis, Manihot esculenta [manihot, arrowroot, tapioca, cassaya] or Ricinus communis [castor bean, Castor Oil Bush, Castor Oil Plant, Palma Christi, Wonder Tree]; Fabaceae such as the genera Pisum, Albizia, Cathormion, Feuillea, Inga, Pithecolobium, Acacia, Mimosa, Medicajo, Glycine, Dolichos, Phaseolus, Soja e.g. the species Pisum sativum, Pisum arvense, Pisum humile [pea], Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa [bastard logwood, silk tree, East Indian Walnut], Medicago sativa, Medicago falcata, Medicago varia [alfalfa] Glycine max Dolichos soja, Glycine gracilis, Glycine hispida, Phaseolus max, Soja hispida or Soja max [soybean]; Geraniaceae such as the genera Pelargonium, Cocos, Oleum e.g. the species Cocos nucifera, Pelargonium grossularioides or Oleum cocois [coconut]; Gramineae such as the genera Saccharum e.g. the species Saccharum officinarum; Juglandaceae such as the genera Juglans, Wallia e.g. the species Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra or Wallia nigra [walnut, black walnut, common walnut, persian walnut, white walnut, butternut, black walnut]; Lauraceae such as the genera Persea, Laurus e.g. the species laurel Laurus nobilis [bay, laurel, bay laurel, sweet bay], Persea americana Persea americana, Persea gratissima or Persea persea [avocado]; Leguminosae such as the genera Arachis e.g. the species Arachis hypogaea [peanut]; Linaceae such as the genera Linum, Adenolinum e.g. the species Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne var. lewisii, Linum pratense or Linum trigynum [flax, linseed]; Lythrarieae such as the genera Punica e.g. the species Punica granatum [pomegranate]; Malvaceae such as the genera Gossypium e.g. the species Gossypium hirsutum, Gossypium arboreum, Gossypium barbadense, Gossypium herbaceum or Gossypium thurberi [cotton]; Musaceae such as the genera Musa e.g. the species Musa nana, Musa acuminata, Musa paradisiaca, Musa spp. [banana]; Onagraceae such as the genera Camissonia, Oenothera e.g. the species Oenothera biennis or Camissonia brevipes [primrose, evening primrose]; Palmae such as the genera Elacis e.g. the species Elaeis guineensis [oil plam]; Papaveraceae such as the genera

*Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata*. [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon., Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum* [Sorghum, millet], *Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat], Proteaceae such as the genera *Macadamia* e.g. the species *Macadamia intergrifolia* [macadamia]; Rubiaceae such as the genera *Coffea* e.g. the species *Cofea* spp., *C. offea arabica, Coffea canephora* or *Coffea liberica* [coffee]; Scrophulariaceae such as the genera *Verbascum* e.g. the species *Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant] (*Lycopersicon esculentum, Lycopersicon lycopersicum., Lycopersicon pyriforme, Solanum integrifolium* or *Solanum lycopersicum* [tomato]; Sterculiaceae such as the genera *Theobroma* e.g. the species *Theobroma cacao* [cacao]; Theaceae such as the genera Camellia e.g. the species *Camellia sinensis*) [tea].

The introduction of the nucleic acids according to the invention, the expression cassette or the vector into organisms, plants for example, can in principle be done by all of the methods known to those skilled in the art. The introduction of the nucleic acid sequences gives rise to recombinant or transgenic organisms.

Unless otherwise specified, the terms "polynucleotides", "nucleic acid" and "nucleic acid molecule" as used herein are interchangeably. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, the terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

The genes of the invention, coding for an activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-keto-reductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease are also called "NUERP gene".

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. The triplets taa, tga and tag represent the (usual) stop codons which are interchangeable. A coding sequence can include, but is not limited to mRNA, cDNA, recombinant nucleotide sequences or genomic DNA, while introns may be present as well under certain circumstances.

The transfer of foreign genes into the genome of a plant is called transformation. In doing this the methods described for the transformation and regeneration of plants from plant tissues or plant cells are utilized for transient or stable transformation. Suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in Jenes B. et al., Techniques for Gene Transfer, in: Transgenic Plants, Vol. 1, Engineering and Utilization, eds. Kung S. D and Wu R., Academic Press (1993) 128-143 and in Potrykus, Annu. Rev. Plant Physiol. Plant Molec. Biol. 42, 205 (1991). The nucleic acids or the construct to be expressed is preferably cloned into a vector which is suitable for transforming *Agrobacterium tumefaciens*, for example pBin19 (Bevan et al., Nucl. Acids Res. 12, 8711 (1984)). *Agrobacteria* transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. 16, 9877 (1988) or is known inter alia from White F. F., Vectors for Gene Transfer in Higher Plants; in Transgenic Plants, Vol. 1, Engineering and Utilization, eds. Kung S. D. and Wu R., Academic Press, 1993, pp. 15-38.

*Agrobacteria* transformed by an expression vector according to the invention may likewise be used in known manner for the transformation of plants such as test plants like *Arabidopsis* or crop plants such as cereal crops, corn, oats, rye, barley, wheat, soybean, rice, cotton, sugar beet, canola, sunflower, flax, hemp, potatoes, tobacco, tomatoes, carrots, paprika, oilseed rape, tapioca, cassava, arrowroot, tagetes, alfalfa, lettuce and the various tree, nut and vine species, in particular oil-containing crop plants such as soybean, peanut, castor oil plant, sunflower, corn, cotton, flax, oilseed rape, coconut, oil palm, safflower (*Carthamus tinctorius*) or cocoa bean, or in particular corn, wheat, soybean, rice, cotton and canola, e.g. by bathing bruised leaves or chopped leaves in an agrobacterial solution and then culturing them in suitable media.

The genetically modified plant cells may be regenerated by all of the methods known to those skilled in the art. Appropriate methods can be found in the publications referred to above by Kung S. D. and Wu R., Potrykus or Hofgen and Willmitzer.

Accordingly, a further aspect of the invention relates to transgenic organisms transformed by at least one nucleic acid sequence, expression cassette or vector according to the invention as well as cells, cell cultures, tissue, parts—such as, for example, leaves, roots, etc. in the case of plant organisms—or reproductive material derived from such organisms. The terms "host organism", "host cell", "recombinant (host) organism" and "transgenic (host) cell" are used here interchangeably. Of course these terms relate not only to the particular host organism or the particular target cell but also to the descendants or potential descendants of these organisms or cells. Since, due to mutation or environmental effects certain modifications may arise in successive generations, these descendants need not necessarily be identical with the parental cell but nevertheless are still encompassed by the term as used here.

For the purposes of the invention "transgenic" or "recombinant" means with regard for example to a nucleic acid sequence, an expression cassette (=gene construct, nucleic acid construct) or a vector containing the nucleic acid sequence according to the invention or an organism transformed by the nucleic acid sequences, expression cassette or vector according to the invention all those constructions produced by genetic engineering methods in which either
(a) the nucleic acid sequence depicted in table I, application no. 1, column 5 or 7 or its derivatives or parts thereof; or
(b) a genetic control sequence functionally linked to the nucleic acid sequence described under (a), for example a 3'- and/or 5'-genetic control sequence such as a promoter or terminator, or
(c) (a) and (b);
are not found in their natural, genetic environment or have been modified by genetic engineering methods, wherein the modification may by way of example be a substitution, addition, deletion, inversion or insertion of one or more nucleotide residues. Natural genetic environment means the natural genomic or chromosomal locus in the organism of origin or inside the host organism or presence in a genomic library. In the case of a genomic library the natural genetic environment of the nucleic acid sequence is preferably retained at least in part. The environment borders the nucleic acid sequence at least on one side and has a sequence length of at least 50 bp, preferably at least 500 bp, particularly preferably at least 1,000 bp, most particularly preferably at least 5,000 bp. A naturally occurring expression cassette—for example the naturally occurring combination of the natural promoter of the nucleic acid sequence according to the invention with the corresponding gene—turns into a transgenic expression cassette when the latter is modified by unnatural, synthetic ("artificial") methods such as by way of example a mutagenation. Appropriate methods are described by way of example in U.S. Pat. No. 5,565,350 or WO 00/15815.

Suitable organisms or host organisms for the nucleic acid, expression cassette or vector according to the invention are advantageously in principle all organisms, which are suitable for the expression of recombinant genes as described above. Further examples which may be mentioned are plants such as *Arabidopsis*, *Asteraceae* such as *Calendula* or crop plants such as soybean, peanut, castor oil plant, sunflower, flax, corn, cotton, flax, oilseed rape, coconut, oil palm, safflower (*Carthamus tinctorius*) or cocoa bean.

In one embodiment of the invention host plants for the nucleic acid, expression cassette or vector according to the invention are selected from the group comprising corn, soy, oil seed rape (including canola and winter oil seed rape), cotton, wheat and rice.

A further object of the invention relates to the use of a nucleic acid construct, e.g. an expression cassette, containing DNA sequences encoding polypeptides shown in table II or DNA sequences hybridizing therewith for the transformation of plant cells, tissues or parts of plants.

In doing so, depending on the choice of promoter, the sequences shown in table I can be expressed specifically in the leaves, in the seeds, the nodules, in roots, in the stem or other parts of the plant. Those transgenic plants overproducing sequences as depicted in table I, the reproductive material thereof, together with the plant cells, tissues or parts thereof are a further object of the present invention.

The expression cassette or the nucleic acid sequences or construct according to the invention containing sequences according to table I can, moreover, also be employed for the transformation of the organisms identified by way of example above such as bacteria, yeasts, filamentous fungi and plants.

Within the framework of the present invention, increased yield, especially enhanced NUE and/or biomass production, means, for example, the artificially acquired trait of increased yield, especially of enhanced NUE and/or biomass production, due to functional over expression of polypeptide sequences of table II encoded by the corresponding nucleic acid molecules as depicted in table I, column 5 or 7 and/or homologs in the organisms according to the invention, advantageously in the transgenic plants according to the invention, by comparison with the nongenetically modified initial plants at least for the duration of at least one plant generation.

A constitutive expression of the polypeptide sequences of table II, application no. 1, encoded by the corresponding nucleic acid molecule as depicted in table I, application no. 1, column 5 or 7 and/or homologs is, moreover, advantageous. On the other hand, however, an inducible expression may also appear desirable. Expression of the polypeptide sequences of the invention can be either direct to the cytoplasm or the organelles, preferably the plastids of the host cells, preferably the plant cells.

The efficiency of the expression of the sequences of the of table II, application no. 1, encoded by the corresponding nucleic acid molecule as depicted in table I, application no. 1, column 5 or 7 and/or homologs can be determined, for example, in vitro by shoot meristem propagation. In addition, an expression of the sequences of table II, application no. 1, encoded by the corresponding nucleic acid molecule as depicted in table I, application no. 1, column 5 or 7 and/or homologs modified in nature and level and its effect effect on yield, particularly tolerance to abiotic environmental stress and/or nutrient use efficiency, but also on the metabolic pathways performance can be tested on test plants in greenhouse trials.

An additional object of the invention comprises transgenic organisms such as transgenic plants transformed by an expression cassette containing sequences of as depicted in table I, application no. 1, column 5 or 7 according to the invention or DNA sequences hybridizing therewith, as well as transgenic cells, tissue, parts and reproduction material of such plants. Particular preference is given in this case to transgenic crop plants such as by way of example barley, wheat, rye, oats, corn, soybean, rice, cotton, sugar beet, oilseed rape and canola, sunflower, flax, hemp, thistle, potatoes, tobacco, tomatoes, tapioca, cassaya, arrowroot, alfalfa, lettuce and the various tree, nut and vine species.

In one embodiment of the invention transgenic plants transformed by an expression cassette containing sequences of as depicted in table I, application no. 1, column 5 or 7 according to the invention or DNA sequences hybridizing therewith are selected from the group comprising corn, soy, oil seed rape (including canola and winter oil seed rape), cotton, wheat and rice.

For the purposes of the invention plants are mono- and dicotyledonous plants, mosses or algae, especially plants, preferably monocotyledonous plants, or preferably dicotyledonous plants.

A further refinement according to the invention are transgenic plants as described above which contain a nucleic acid sequence or construct according to the invention or a expression cassette according to the invention.

However, transgenic also means that the nucleic acids according to the invention are located at their natural position in the genome of an organism, but that the sequence has been modified in comparison with the natural sequence and/or that the regulatory sequences of the natural sequences have been modified. Preferably, transgenic/recombinant is to be understood as meaning the transcription of the nucleic acids of the invention and shown in table I, occurs at a non-natural position in the genome, that is to say the expression of the nucleic acids is homologous or, preferably, heterologous. This expression can be transiently or of a sequence integrated stably into the genome.

The term "transgenic plants" used in accordance with the invention also refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant.

Any transformed plant obtained according to the invention can be used in a conventional breeding scheme or in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art.

Advantageous inducible plant promoters are by way of example the PRP1 promoter (Ward et al., Plant. Mol. Biol. 22361 (1993)), a promoter inducible by benzenesulfonamide (EP 388 186), a promoter inducible by tetracycline (Gatz et al., Plant J. 2, 397 (1992)), a promoter inducible by salicylic acid (WO 95/19443), a promoter inducible by abscisic acid (EP 335 528) and a promoter inducible by ethanol or cyclohexanone (WO 93/21334). Other examples of plant promoters which can advantageously be used are the promoter of cytosolic FBPase from potato, the ST-LSI promoter from potato (Stockhaus et al., EMBO J. 8, 2445 (1989)), the promoter of phosphoribosyl pyrophosphate amidotransferase from *Glycine max* (see also gene bank accession number U87999) or a nodiene-specific promoter as described in EP 249 676. Particular advantageous are those promoters which ensure expression upon conditions of limited nutrient availability, e.g. the onset of limited nitrogen sources in case the nitrogen of the soil or nutrient is exhausted, and/or expression upon at the onset of chilling and/or freezing temperatures and/or water deficiency, as defined hereinabove. Such promotors are known to the person skilled in the art or can be isolated from genes which are induced under the conditions mentioned above.

In one embodiment seed-specific promoters may be used for monocotyledonous or dicotyledonous plants.

In principle all natural promoters with their regulation sequences can be used like those named above for the expression cassette according to the invention and the method according to the invention. Over and above this, synthetic promoters may also advantageously be used.

In the preparation of an expression cassette various DNA fragments can be manipulated in order to obtain a nucleotide sequence, which usefully reads in the correct direction and is equipped with a correct reading frame. To connect the DNA fragments (=nucleic acids according to the invention) to one another adaptors or linkers may be attached to the fragments.

The promoter and the terminator regions can usefully be provided in the transcription direction with a linker or polylinker containing one or more restriction points for the insertion of this sequence. Generally, the linker has 1 to 10, mostly 1 to 8, preferably 2 to 6, restriction points. In general the size of the linker inside the regulatory region is less than 100 bp, frequently less than 60 bp, but at least 5 bp. The promoter may be both native or homologous as well as foreign or heterologous to the host organism, for example to the host plant. In the 5'-3' transcription direction the expression cassette contains the promoter, a DNA sequence which shown in table I and a region for transcription termination. Different termination regions can be exchanged for one another in any desired fashion.

As also used herein, the terms "nucleic acid" and "nucleic acid molecule" are intended to include DNA molecules (e.g. cDNA or genomic DNA) and RNA molecules (e.g. mRNA) and analogs of the DNA or RNA generated using nucleotide analogs. This term also encompasses untranslated sequence located at both the 3' and 5' ends of the coding region of the gene—at least about 1000 nucleotides of sequence upstream from the 5' end of the coding region and at least about 200 nucleotides of sequence downstream from the 3' end of the coding region of the gene. The nucleic acid molecule can be single-stranded or double-stranded, but preferably is double-stranded DNA.

An "isolated" nucleic acid molecule is one that is substantially separated from other nucleic acid molecules, which are present in the natural source of the nucleic acid. That means other nucleic acid molecules are present in an amount less than 5% based on weight of the amount of the desired nucleic acid, preferably less than 2% by weight, more preferably less than 1% by weight, most preferably less than 0.5% by weight. Preferably, an "isolated" nucleic acid is free of some of the sequences that naturally flank the nucleic acid (i.e., sequences located at the 5' and 3' ends of the nucleic acid) in the genomic DNA of the organism from which the nucleic acid is derived. For example, in various embodiments, the isolated NUE related protein (NUERP) encoding nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an "isolated" nucleic acid molecule, such as a cDNA molecule, can be free from some of the other cellular material with which it is naturally associated, or culture medium when produced by recombinant techniques, or chemical precursors or other chemicals when chemically synthesized.

A nucleic acid molecule of the present invention, e.g., a nucleic acid molecule encoding an NUERP or a portion thereof which confers enhanced tolerance to abiotic environmental stress and/or enhanced nutrient use efficiency and/or increased yield, especially enhanced NUE and/or increased biomass production, in plants, can be isolated using standard molecular biological techniques and the sequence information provided herein. For example, an *Arabidopsis thaliana* NUERP encoding cDNA can be isolated from a *A. thaliana* c-DNA library or a *Synechocystis* sp., *Brassica napus, Glycine max, Zea mays* or *Oryza sativa* NUERP encoding cDNA can be isolated from a *Synechocystis* sp., *Brassica napus, Glycine max, Zea mays* or *Oryza sativa* c-DNA library respectively using all or portion of one of the sequences shown in table I. Moreover, a nucleic acid molecule encompassing all or a portion of one of the sequences of table I can be isolated by the polymerase chain reaction using oligonucleotide primers designed based upon this sequence. For example, mRNA can be isolated from plant cells (e.g., by the guanidinium-thiocyanate extraction procedure of Chirgwin et al., Biochemistry 18, 5294 (1979)) and cDNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the nucleotide sequences shown in table I. A nucleic acid molecule of the invention can be amplified using cDNA or, alternatively, genomic DNA, as a template and appropriate oligonucleotide primers according to standard PCR amplification techniques. The nucleic acid molecule so amplified can be cloned into an appropriate vector and characterized by DNA sequence analysis. Furthermore, oligonucleotides corresponding to a NUERP encoding nucleotide sequence can be prepared by standard synthetic techniques, e.g., using an automated DNA synthesizer.

In a preferred embodiment, an isolated nucleic acid molecule of the invention comprises one of the nucleotide sequences shown in table I encoding the NUERP (i.e., the "coding region"), as well as 5' untranslated sequences and 3' untranslated sequences.

Moreover, the nucleic acid molecule of the invention can comprise only a portion of the coding region of one of the sequences of the nucleic acid of table I, for example, a fragment which can be used as a probe or primer or a fragment encoding a biologically active portion of a NUERP.

Portions of proteins encoded by the NUERP encoding nucleic acid molecules of the invention are preferably biologically active portions described herein. As used herein, the term "biologically active portion of" a NUERP is intended to include a portion, e.g. a domain/motif, of NUE related protein (NUERP), which is sufficient to confer enhanced yield, particularly due to one or more improved yield related traits as defined above, especially which participates in an enhanced NUE efficiency and/or increased biomass production, in a plant. To determine whether a NUERP, or a biologically active portion thereof, results in an enhanced yield, particularly due to one or more improved yield related traits as defined above, especially an enhanced NUE efficiency and/or increased biomass production, in a plant, an analysis of a plant comprising the NUERP may be performed. Such analysis methods are well known to those skilled in the art, as detailed in the Examples. More specifically, nucleic acid fragments encoding biologically active portions of a NUERP can be prepared by isolating a portion of one of the sequences of the nucleic acid of table I expressing the encoded portion of the NUERP or peptide (e.g., by recombinant expression in vitro) and assessing the activity of the encoded portion of the NUERP or peptide.

Biologically active portions of a NUERP are encompassed by the present invention and include peptides comprising amino acid sequences derived from the amino acid sequence of a NUERP encoding gene, or the amino acid sequence of a protein homologous to a NUERP, which include fewer amino acids than a full length NUERP or the full length protein which is homologous to a NUERP, and exhibits at least some enzymatic or biological activity of a NUERP. Typically, biologically active portions (e.g., peptides which are, for example, 5, 10, 15, 20, 30, 35, 36, 37, 38, 39, 40, 50, 100 or more amino acids in length) comprise a domain or motif with at least one activity of a NUERP. Moreover, other biologically active portions in which other regions of the protein are deleted, can be prepared by recombinant techniques and evaluated for one or more of the activities described herein. Preferably, the biologically active portions of a NUERP include one or more selected domains/motifs or portions thereof having biological activity.

The term "biological active portion" or "biological activity" means a polypeptide as depicted in table II, column 3 or a portion of said polypeptide which still has at least 10% or 20%, preferably 30%, 40%, 50% or 60%, especially preferably 70%, 75%, 80%, 90% or 95% of the enzymatic or biological activity of the natural or starting enzyme or protein.

In the process according to the invention nucleic acid sequences can be used, which, if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes.

Preferably, the nucleic acid molecule used in the process according to the invention or the nucleic acid molecule of the invention is an isolated nucleic acid molecule.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example the polynucleotide of the invention or of a part thereof can be isolated using molecular-biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this very sequence. For example, mRNA can be isolated from cells (for example by means of the guanidinium thiocyanate extraction method of Chirgwin et al., Biochemistry 18, 5294 (1979)) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as shown in table III, column 7, by means of polymerase chain reaction can be generated on the basis of a sequence shown herein, for example the sequence shown in table I, application no. 1, columns 5 and 7 or the sequences derived from table II, application no. 1, columns 5 and 7.

Moreover, it is possible to identify conserved protein by carrying out protein sequence alignments with the polypeptide encoded by the nucleic acid molecules of the present invention, in particular with the sequences encoded by the nucleic acid molecule shown in column 5 or 7 of table I, application no. 1, from which conserved regions, and in turn, degenerate primers can be derived.

Conserved regions are those, which show a very little variation in the amino acid in one particular position of several homologs from different origin. The consensus sequence and polypeptide motifs shown in column 7 of table IV, application no. 1, are derived from said alignments. Moreover, it is possible to identify conserved regions from various organisms by carrying out protein sequence alignments with the polypeptide encoded by the nucleic acid of the present invention, in particular with the sequences encoded by the polypeptide molecule shown in column 5 or 7 of table II, from which conserved regions, and in turn, degenerate primers can be derived.

In one advantageous embodiment, in the method of the present invention the activity of a polypeptide is increased comprising or consisting of a consensus sequence or a polypeptide motif shown in table IV, application no. 1, column 7 and in one another embodiment, the present invention relates to a polypeptide comprising or consisting of a consensus sequence or a polypeptide motif shown in table IV, application no. 1, column 7 whereby less than 20, preferably less than 15 or 10, preferably less than 9, 8, 7, or 6, more preferred less than 5 or 4, even more preferred less then 3, even more preferred less then 2, even more preferred 0 of the amino acids positions indicated can be replaced by any amino acid. In one embodiment not more than 15%, preferably 10%, even more preferred 5%, 4%, 3%, or 2%, most preferred 1% or 0% of the amino acid position indicated by a letter are/is replaced another amino acid. In one embodiment less than 20, preferably less than 15 or 10, preferably less than 9, 8, 7, or 6, more preferred less than 5 or 4, even more preferred less than 3, even more preferred less than 2, even more preferred 0 amino acids are inserted into a consensus sequence or protein motif.

The consensus sequence was derived from a multiple alignment of the sequences as listed in table II. The letters represent the one letter amino acid code and indicate that the amino acids are conserved in at least 80% of the aligned proteins. The letter X stands for amino acids, which are not conserved in at least 80% sequences. The consensus sequence starts with the first conserved amino acid in the alignment, and ends with the last conserved amino acid in the alignment of the investigated sequences. The number of given X indicates the distances between conserved amino acid residues, e.g. Y-x(21,23)-F means that conserved tyrosine and phenylalanine residues are separated from each other by minimum 21 and maximum 23 amino acid residues in all investigated sequences.

Conserved domains were identified from all sequences and are described using a subset of the standard Prosite notation, e.g. the pattern Y-x(21,23)-[FW] means that a conserved tyrosine is separated by minimum 21 and maximum 23 amino acid residues from either a phenylalanine or tryptophane. Patterns had to match at least 80% of the investigated proteins.

Conserved patterns were identified with the software tool MEME version 3.5.1 or manually. MEME was developed by Timothy L. Bailey and Charles Elkan, Dept. of Computer Science and Engeneering, University of California, San Diego, USA and is described by Timothy L. Bailey and Charles Elkan (Fitting a mixture model by expectation maximization to discover motifs in biopolymers, Proceedings of the Second International Conference on Intelligent Systems for Molecular Biology, pp. 28-36, AAAI Press, Menlo Park, Calif., 1994). The source code for the stand-alone program is public available from the San Diego Supercomputer center (http://meme.sdsc.edu).

For identifying common motifs in all sequences with the software tool MEME, the following settings were used: -maxsize 500000, -nmotifs 15, -evt 0.001, -maxw 60,-distance 1e-3, -minsites number of sequences used for the analysis. Input sequences for MEME were non-aligned sequences in Fasta format. Other parameters were used in the default settings in this software version.

Prosite patterns for conserved domains were generated with the software tool Pratt version 2.1 or manually. Pratt was developed by Inge Jonassen, Dept. of Informatics, University of Bergen, Norway and is described by Jonassen et al. (I. Jonassen, J. F. Collins and D. G. Higgins, Finding flexible patterns in unaligned protein sequences, Protein Science 4 (1995), pp. 1587-1595; I. Jonassen, Efficient discovery of conserved patterns using a pattern graph, Submitted to CABIOS Febr. 1997]. The source code (ANSI C) for the stand-alone program is public available, e.g. at established Bioinformatic centers like EBI (European Bioinformatics Institute).

For generating patterns with the software tool Pratt, following settings were used: PL (max Pattern Length): 100, PN (max Nr of Pattern Symbols): 100, PX (max Nr of consecutive x's): 30, FN (max Nr of flexible spacers): 5, FL (max Flexibility): 30, FP (max Flex.Product): 10, ON (max number patterns): 50. Input sequences for Pratt were distinct regions of the protein sequences exhibiting high similarity as identified from software tool MEME. The minimum number of sequences, which have to match the generated patterns (CM, min Nr of Seqs to Match) was set to at least 80% of the provided sequences. Parameters not mentioned here were used in their default settings.

The Prosite patterns of the conserved domains can be used to search for protein sequences matching this pattern. Various established Bioinformatic centers provide public Internet portals for using those patterns in database searches (e.g. PIR (Protein Information Resource, located at Georgetown University Medical Center) or ExPASy (Expert Protein Analysis System)). Alternatively, stand-alone software is available, like the program Fuzzpro, which is part of the EMBOSS software package. For example, the program Fuzzpro not only allows searching for an exact pattern-protein match but also allows setting various ambiguities in the performed search.

The alignment was performed with the software ClustalW (version 1.83) and is described by Thompson et al. (Nucleic Acids Research 22, 4673 (1994)). The source code for the stand-alone program is public available from the European Molecular Biology Laboratory; Heidelberg, Germany. The analysis was performed using the default parameters of ClustalW v1.83 (gap open penalty: 10.0; gap extension penalty: 0.2; protein matrix: Gonnet; protein/DNA endgap: −1; protein/DNA gapdist: 4).

Degenerated primers can then be utilized by PCR for the amplification of fragments of novel proteins having abovementioned activity, e.g. conferring conferring the increase in yield, particularly enhanced tolerance to abiotic environmental stress and/or enhanced nutrient use efficiency, especially the enhanced NUE and/or increased biomass production, as compared to a corresponding non-transformed wild type plant cell, plant or part thereof after increasing the expression or activity or having the activity of a protein as shown in table II, application no. 1, column 3 or further functional homologs of the polypeptide of the invention from other organisms.

These fragments can then be utilized as hybridization probe for isolating the complete gene sequence. As an alternative, the missing 5' and 3' sequences can be isolated by means of RACE-PCR. A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process, can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalents have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, 2$^{nd}$ Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, nonlimiting example of stringent hybridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×, 0.5×, 1×, 2×, 3×, 4× or 5× SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 by (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2× SSC at 50° C., preferably at 65° C.) (20×SSC: 0.3 M sodium citrate, 3 M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like 1) length of treatment, 2) salt conditions, 3) detergent conditions, 4) competitor DNAs, 5) temperature and 6) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2h. Hybridization with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2h. The hybridization with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some examples of conditions for DNA hybridization (Southern blot assays) and wash step are shown herein below:
(1) Hybridization conditions can be selected, for example, from the following conditions:
   (a) 4×SSC at 65° C.,
   (b) 6×SSC at 45° C.,
   (c) 6×SSC, 100 mg/ml denatured fragmented fish sperm DNA at 68° C.,
   (d) 6×SSC, 0.5% SDS, 100 mg/ml denatured salmon sperm DNA at 68° C.,
   (e) 6×SSC, 0.5% SDS, 100 mg/ml denatured fragmented salmon sperm DNA, 50% formamide at 42° C.,
   (f) 50% formamide, 4×SSC at 42° C.,
   (g) 50% (v/v) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
   (h) 2× or 4×SSC at 50° C. (low-stringency condition), or
   (i) 30 to 40% formamide, 2× or 4×SSC at 42° C. (low-stringency condition).
(2) Wash steps can be selected, for example, from the following conditions:
   (a) 0.015 M NaCl/0.0015 M sodium citrate/0.1% SDS at 50° C.
   (b) 0.1×SSC at 65° C.
   (c) 0.1×SSC, 0.5% SDS at 68° C.
   (d) 0.1×SSC, 0.5% SDS, 50% formamide at 42° C.
   (e) 0.2×SSC, 0.1% SDS at 42° C.
   (f) 2×SSC at 65° C. (low-stringency condition).

Polypeptides having above-mentioned activity, i.e. conferring increase in yield, especially enhanced NUE and/or increased biomass production, as compared to a corresponding non-transformed wild type plant cell, plant or part thereof, derived from other organisms, can be encoded by other DNA sequences which hybridize to the sequences shown in table I, application no. 1, columns 5 and 7 under relaxed hybridization conditions and which code on expression for peptides conferring increase in yield, especially the enhanced NUE efficiency and/or increased biomass production, as compared to a corresponding non-transformed wild type plant cell, plant or part thereof.

Further, some applications have to be performed at low stringency hybridization conditions, without any conse- quences for the specificity of the hybridization. For example, a Southern blot analysis of total DNA could be probed with a nucleic acid molecule of the present invention and washed at low stringency (55° C. in 2×SSPE, 0.1% SDS). The hybridization analysis could reveal a simple pattern of only genes encoding polypeptides of the present invention or used in the process of the invention, e.g. having the herein-mentioned activity of enhancing the NUE and/or increasing the biomass production as compared to a corresponding non-transformed wild type plant cell, plant or part thereof. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridization conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, or 30 bp. Preferably are also hybridizations with at least 100 by or 200, very especially preferably at least 400 by in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence referred to or hybridizing with the nucleic acid molecule of the invention or used in the process of the invention under stringend conditions, while the maximum size is not critical. In some applications, the maximum size usually is not substantially greater than that required to provide the desired activity and/or function(s) of the original sequence.

Typically, the truncated amino acid sequence will range from about 5 to about 310 amino acids in length. More typically, however, the sequence will be a maximum of about 250 amino acids in length, preferably a maximum of about 200 or 100 amino acids. It is usually desirable to select sequences of at least about 10, 12 or 15 amino acids, up to a maximum of about 20 or 25 amino acids.

The term "epitope" relates to specific immunoreactive sites within an antigen, also known as antigenic determinates. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to a epitope of the polypeptide of the present invention or used in the process of the present invention and confers an increased yield, especially an enhanced NUE and/or an increased biomass production, as compared to a corresponding non-transformed wild type plant cell, plant or part thereof.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences shown in table I, application no. 1, columns 5 and 7 is one which is sufficiently complementary to one of the nucleotide sequences shown in table I, columns 5 and 7 such that it can hybridize to one of the nucleotide sequences shown in table I, application no. 1, columns 5 and 7, thereby forming a stable duplex. Preferably, the hybridization is performed under stringent hybridization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, application no. 1, columns 5 and 7, or a portion thereof and preferably has above mentioned activity, in particular an increase in yield, especially having a NUE enhancing activity and/or biomass production increasing activity, after increasing the activity or an activity of a gene product as shown in table II, application no. 1, column 3 by for example expression either in the cytsol or in an organelle such as a plastid or mitochondria or both, preferably in plastids.

The nucleic acid molecule of the invention comprises a nucleotide sequence which hybridizes, preferably hybridizes under stringent conditions as defined herein, to one of the nucleotide sequences shown in table I, application no. 1, columns 5 and 7, or a portion thereof and encodes a protein having above-mentioned activity, e.g. conferring an increased yield, especially an enhanced NUE and/or increased biomass production, as compared to a corresponding non-transformed wild type plant cell, plant or part thereof by for example expression either in the cytsol or in an organelle such as a plastid or mitochondria or both, preferably in plastids, and optionally, the activity selected from the group consisting of 2-dehydro-3-deoxy-phosphoheptonate aldolase, 3-keto sterol reductase, 60S ribosomal protein, adenine phosphoribosyltransferase, adenylate kinase, alkyl hydroperoxide reductase, Alkyl/aryl-sulfatase, alpha-glucosidase, alpha-mannosidase, anaphase promoting complex (APC) subunit, antiviral adaptor protein, aromatic amino acid aminotransferase II, ARV1 protein, autophagy-specific phosphatidylinositol 3-kinase complex protein subunit, b0017-protein, B0165-protein, B1258-protein, B1267-protein, B1381-protein, b1933-protein, b2165-protein, b2238-protein, b2431-protein, B2646-protein, b2766-protein, b3120-protein, carnitine acetyltransferase, cell wall endo-beta-1,3-glucanase, chaperone, Chitin synthase 3 complex protein, cholinephosphate cytidylyltransferase, chorismate mutase T/prephenate dehydrogenase (bifunctional), clathrin associated protein complex small subunit, component of the RAM signaling network, cysteine transporter, cytochrome c oxidase subunit VIII, cytosolic catalase, cytosolic serine hydroxymethyltransferase, dihydroorotate dehydrogenase, dihydrosphingosine phosphate lyase, exoribonuclease, F1F0 ATP synthase beta subunit, Factor arrest protein, G protein coupled pheromone receptor receptor, gamma-glutamyl kinase, glucoamylase, glycerol-3-phosphate transporter subunit, glycine decarboxylase, glycosyltransferase, golgi membrane exchange factor subunit, golgi membrane protein, GPI-anchored cell wall protein, GTP-binding protein, helix-loop-helix transcription activator that binds inositol/choline-responsive elements, hexose transporter, histidine kinase osmosensor that regulates an osmosensing MAP kinase cascade, hydro-lyase, hydroxylamine reductase, hydroxymyristol acyl carrier protein dehydratase, inheritance of peroxisomes protein, integral membrane protein localized to late Golgi vesicles, iron sulfur cluster assembly protein, isomerase, lysine/arginine/ornithine transporter subunit, lysine-specific metalloprotease, lysophospholipase, Mcm1p binding transcriptional repressor, Meiotic recombination protein, membrane protein, metal ion transporter, microsomal beta-ketoreductase, mitochondrial intermembrane space protein, mitochondrial protein, mitochondrial ribosomal protein of the large subunit, mitochondrial ribosomal protein of the small subunit, mitochondrial seryl-tRNA synthetase, molybdopterin biosynthesis protein, myo-inositol transporter, non-essential kinetochore protein, non-essential Ras guanine nucleotide exchange factor, non-essential small GTPase of the Rho/Rac subfamily of Ras-like proteins, Nuclear cap-binding protein complex subunit, nuclear fusion protein precursor, nuclear pore complex subunit, origin recognition complex subunit, outer membrane usher protein, oxidoreductase, peptide transporter, peptidyl-prolyl cis-trans isomerase, PhoH-like protein, phosphatidylserine decarboxylase, phosphoglucomutase/phosphomannomutase, phosphopantothenoylcysteine decarboxylase, Phosphoribosylaminoimidazole carboxylase, potassium:hydrogen antiporter, proline dehydrogenase, protein component of the large ribosomal subunit, protein involved in shmoo formation and bipolar bud site selection, protein involved in sphingolipid biosynthesis, protein kinase, protein necessary for structural stability of L-A double-stranded RNA-containing particles, protein required for maturation of ribosomal RNAs, protein translocase protein, Regulatory CAT8 protein, regulatory subunit of Glc7p type 1 protein serine-threonine phosphatase, regulatory subunit of the 26S proteasome, repressor of G1 transcription, Rho GDP-dissociation inhibitor, ribonucleoprotein, ribosomal protein of the small subunit, RNA polymerase III subunit, saccharopine dehydrogenase, short chain fatty acid transporter, signal recognition particle subunit (SRP54), signal transducing MEK kinase, SM complex B protein for mRNA splicing, spindle checkpoint complex subunit, splicing factor, Stationary phase protein, subunit of cytoplasmic phenylalanyl-tRNA synthetase, subunit of the transport protein particle (TRAPP) complex of the cis-Golgi, threonine ammonia-lyase, transcription elongation factor, transcription factor, Transcriptional activator, translational elongation factor EF-3 (HEF3), transmembrane protein with a role in cell wall polymer composition, transport protein, ubiquitin regulatory protein, UDP-N-acetyl-glucosamine-1-P transferase, v-SNARE binding protein, v-SNARE protein involved in Golgi transport, xylitol dehydrogenase, yal019w-protein, ybr262c-protein, YDR070C-protein, ydr355c-protein, YFR007W-protein, ygr122c-a-protein, ygr266w-protein, ygr290w-protein, YHL005C-protein, yhl021c-protein, yhr127w-protein, YJL010C-protein, yjl064w-protein, yjl067w-protein, yjl213w-protein, ykl100c-protein, YKL111C-protein, ykl131w-protein, ykr016w-protein, ykr021w-protein, yll014w-protein, yll023c-protein, yll037w-protein, yll049w-protein, ylr042c-protein, YLR053c-protein, ylr065c-protein, ylr125w-protein, ylr404w-protein, ylr463c-protein, yml089c-protein, YML101C-protein, yml128c-protein, YMR082C-protein, YMR126C membrane protein, YMR144W-protein, YMR160W-protein, YMR209C-protein, YMR233W-protein, YNL320W-protein, YOR097C-protein, YOR203W-protein, YPL068C-protein, Zinc finger protein, and zinc metalloprotease.

Moreover, the nucleic acid molecule of the invention can comprise only a portion of the coding region of one of the sequences shown in table I, application no. 1, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increased yield, especially an enhanced NUE and/or biomass production, as compared to a corresponding non-transformed wild type plant cell, plant or part thereof f its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, preferably about 20 or 25, more preferably about 40, 50 or 75 consecutive nucleotides of a sense strand of one of the sequences set forth, e.g., in table I, application no. 1, columns 5 and 7, an anti-sense sequence of one of the sequences, e.g., set forth in table I, application no. 1, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, application no. 1, column 7 will result in a fragment of the gene product as shown in table II, application no. 1, column 3.

Primer sets are interchangeable. The person skilled in the art knows to combine said primers to result in the desired product, e.g. in a full length clone or a partial sequence. Probes based on the sequences of the nucleic acid molecule of the invention or used in the process of the present invention can be used to detect transcripts or genomic sequences encoding the same or homologous proteins. The probe can further comprise a label group attached thereto, e.g. the label group can be a radioisotope, a fluorescent compound, an enzyme, or an enzyme co-factor. Such probes can be used as a part of a genomic marker test kit for identifying cells which express an polypepetide of the invention or used in the process of the present invention, such as by measuring a level of an encoding nucleic acid molecule in a sample of cells, e.g., detecting mRNA levels or determining, whether a genomic gene comprising the sequence of the polynucleotide of the invention or used in the process of the present invention has been mutated or deleted.

The nucleic acid molecule of the invention encodes a polypeptide or portion thereof which includes an amino acid sequence which is sufficiently homologous to the amino acid sequence shown in table II, application no. 1, columns 5 and 7 such that the protein or portion thereof maintains the ability to participate in increasing yield, especially in the enhancement of NUE and/or increase of biomass production, as compared to a corresponding non-transformed wild type plant cell, plant or part thereof, in particular increasing the activity as mentioned above or as described in the examples in plants is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, application no. 1, columns 5 and 7 such that the protein or portion thereof is able to participate in an increased yield, especially in the enhanced NUE and/or increase of biomass production as compared to a corresponding non-transformed wild type plant cell, plant or part thereof. For examples having the activity of a protein as shown in table II, application no. 1, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, application no. 1, columns 5 and 7 and having above-mentioned activity, e.g. conferring an increased yield, especially an enhanced NUE and/or increased biomass production, as compared to a corresponding non-transformed wild type plant cell, plant or part thereof by for example expression either in the cytosol or in an organelle such as a plastid or mitochondria or both, preferably in plastids.

Portions of proteins encoded by the nucleic acid molecule of the invention are preferably biologically active, preferably having above-mentioned annotated activity, e.g. conferring an increased yield, especially an enhanced NUE and/or increase in biomass production, as compared to a corresponding non-transformed wild type plant cell, plant or part thereof after increase of activity.

As mentioned herein, the term "biologically active portion" is intended to include a portion, e.g., a domain/motif, that confers an increased yield, especially an enhanced NUE and/or increase in biomass production, as compared to a corresponding non-transformed wild type plant cell, plant or part thereof or has an immunological activity such that it is binds to an antibody binding specifically to the polypeptide of the present invention or a polypeptide used in the process of the present invention for an increased yield, especially an enhanced NUE and/or increased biomass production, as compared to a corresponding non-transformed wild type plant cell, plant or part thereof.

The invention further relates to nucleic acid molecules that differ from one of the nucleotide sequences shown in table I A, application no. 1, columns 5 and 7 (and portions thereof) due to degeneracy of the genetic code and thus encode a polypeptide of the present invention, in particular a polypeptide having above mentioned activity, e.g. as that polypeptides depicted by the sequence shown in table II, application no. 1, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, application no. 1, columns 5 and 7 or the functional homologues. In a still further embodiment, the nucleic acid molecule of the invention encodes a full length protein which is substantially homologous to an amino acid sequence shown in table II, application no. 1, columns 5 and 7 or the functional homologues. However, in a preferred embodiment, the nucleic acid molecule of the present invention does not consist of the sequence shown in table I, application no. 1, preferably table IA, columns 5 and 7.

In addition, it will be appreciated by those skilled in the art that DNA sequence polymorphisms that lead to changes in the amino acid sequences may exist within a population. Such genetic polymorphism in the gene encoding the polypeptide of the invention or comprising the nucleic acid molecule of the invention may exist among individuals within a population due to natural variation.

As used herein, the terms "gene" and "recombinant gene" refer to nucleic acid molecules comprising an open reading frame encoding the polypeptide of the invention or comprising the nucleic acid molecule of the invention or encoding the polypeptide used in the process of the present invention, preferably from a crop plant or from a microorganism useful for the method of the invention. Such natural variations can typically result in 1 to 5% variance in the nucleotide sequence of the gene. Any and all such nucleotide variations and resulting amino acid polymorphisms in genes encoding a polypeptide of the invention or comprising a the nucleic acid molecule of the invention that are the result of natural variation and that do not alter the functional activity as described are intended to be within the scope of the invention.

Nucleic acid molecules corresponding to natural variants homologues of a nucleic acid molecule of the invention, which can also be a cDNA, can be isolated based on their homology to the nucleic acid molecules disclosed herein using the nuoleic acid molecule of the invention, or a portion thereof, as a hybridization probe according to standard hybridization techniques under stringent hybridization conditions.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, application no. 1, columns 5 and 7. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

Preferably, nucleic acid molecule of the invention that hybridizes under stringent conditions to a sequence shown in table I, application no. 1, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring increased yield, especially an enhanced NUE and/or increased biomass production, after increasing the expression or activity thereof or the activity of a protein of the invention or used in the process of the invention by for example expression the nucleic acid sequence of the gene product in the cytosol and/or in an organelle such as a plastid or mitochondria, preferably in plastids.

In addition to naturally-occurring variants of the sequences of the polypeptide or nucleic acid molecule of the invention as well as of the polypeptide or nucleic acid molecule used in the process of the invention that may exist in the population, the skilled artisan will further appreciate that changes can be introduced by mutation into a nucleotide sequence of the nucleic acid molecule encoding the polypeptide of the invention or used in the process of the present invention, thereby leading to changes in the amino acid sequence of the encoded said polypeptide, without altering the functional ability of the polypeptide, preferably not decreasing said activity.

For example, nucleotide substitutions leading to amino acid substitutions at "non-essential" amino acid residues can be made in a sequence of the nucleic acid molecule of the invention or used in the process of the invention, e.g. shown in table I, application no. 1, columns 5 and 7.

A "non-essential" amino acid residue is a residue that can be altered from the wild-type sequence of one without altering the activity of said polypeptide, whereas an "essential" amino acid residue is required for an activity as mentioned above, e.g. leading to an increased yield, especially an enhancement of NUE and/or increase of biomass production, as compared to a corresponding non-transformed wild type plant cell, plant or part thereof in an organism after an increase of activity of the polypeptide. Other amino acid residues, however, (e.g., those that are not conserved or only semi-conserved in the domain having said activity) may not be essential for activity and thus are likely to be amenable to alteration without altering said activity.

Further, a person skilled in the art knows that the codon usage between organisms can differ. Therefore, he may adapt the codon usage in the nucleic acid molecule of the present invention to the usage of the organism or the cell compartment for example of the plastid or mitochondria in which the polynucleotide or polypeptide is expressed.

Accordingly, the invention relates to nucleic acid molecules encoding a polypeptide having above-mentioned activity, in an organism or a part thereof by for example expression either in the cytosol or in an organelle such as a plastid or mitochondria or both, preferably in plastids that contain changes in amino acid residues that are not essential for said activity. Such polypeptides differ in amino acid sequence from a sequence contained in the sequences shown in table II, application no. 1, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, application no. 1, columns 5 and 7 and is capable of participation in increasing yield, especially in the enhancement of NUE and/or increase of biomass production, as compared to a corresponding non-transformed wild type plant cell, plant or part thereof after increasing its activity, e.g. its expression by for example expression either in the cytosol or in an organelle such as a plastid or mitochondria or both, preferably in plastids. Preferably, the protein encoded by the nucleic acid molecule is at least about 60% identical to the sequence shown in table II, application no. 1, columns 5 and 7, more preferably at least about 70% identical to one of the sequences shown in table II, application no. 1, columns 5 and 7, even more preferably at least about 80%, 90%, 95% homologous to the sequence shown in table II, application no. 1, columns 5 and 7, and most preferably at least about 96%, 97%, 98%, or 99% identical to the sequence shown in table II, application no. 1, columns 5 and 7.

To determine the percentage homology (=identity, herein used interchangeably) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions ×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman, PNAS 85, 2444 (1988); W. R. Pearson, Methods in Enzymology 183, 63 (1990); W. R. Pearson and D. J. Lipman, PNAS 85, 2444 (1988); W. R. Pearson, Enzymology 183, 63 (1990)). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the query. Nevertheless as this program is very efficient it can be used for the comparison of a huge number of sequences. The following settings are typically used for such a comparisons of sequences:

-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; -q Penalty for a nucleotide mismatch (blastn only) [Integer]; default=-3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perfom gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -I Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSITBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351 (1987), Higgins et al., CABIOS 5, 151 (1989)) or preferably with the programs "Gap" and "Needle", which are both based on the algorithms of Needleman and Wunsch (J. Mol. Biol. 48; 443 (1970)), and "BestFit", which is based on the algorithm of Smith and Waterman (Adv. Appl. Math. 2; 482 (1981)). "Gap" and "BestFit" are part of the GCG software-package (Genetics Computer Group, 575 Science Drive, Madison, Wis., USA 53711 (1991); Altschul et al., (Nucleic Acids Res. 25, 3389 (1997)), "Needle" is part of the The European Molecular Biology Open Software Suite (EMBOSS) (Trends in Genetics 16 (6), 276 (2000)). Therefore preferably the calculations to determine the percentages of sequence homology are done with the programs "Gap" or "Needle" over the whole range of the sequences. The following standard adjustments for the comparison of nucleic acid sequences were used for "Needle": matrix: EDNAFULL, Gap_penalty: 10.0, Extend_penalty: 0.5. The following standard adjustments for the comparison of nucleic acid sequences were used for "Gap": gap weight: 50, length weight: 3, average match: 10.000, average mismatch: 0.000.

For example a sequence, which has 80% homology with sequence SEQ ID NO: 38 at the nucleic acid level is understood as meaning a sequence which, upon comparison with the sequence SEQ ID NO: 38 by the above program "Needle" with the above parameter set, has a 80% homology.

Homology between two polypeptides is understood as meaning the identity of the amino acid sequence over in each case the entire sequence length which is calculated by comparison with the aid of the above program "Needle" using Matrix: EBLOSU M62, Gap_penalty: 8.0, Extend_penalty: 2.0.

For example a sequence which has a 80% homology with sequence SEQ ID NO 39 at the protein level is understood as meaning a sequence which, upon comparison with the sequence SEQ ID NO 39 by the above program "Needle" with the above parameter set, has a 80% homology.

Functional equivalents derived from the nucleic acid sequence as shown in table I, application no. 1, columns 5 and 7 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 1, columns 5 and 7 according to the invention and encode polypeptides having essentially the same properties as the polypeptide as shown in table II, application no. 1, columns 5 and 7.

Functional equivalents derived from one of the polypeptides as shown in table II, application no. 1, columns 5 and 7 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, application no. 1, columns 5 and 7 according to the invention and having essentially the same properties as the polypeptide as shown in table II, application no. 1, columns 5 and 7.

"Essentially the same properties" of a functional equivalent is above all understood as meaning that the functional equivalent has above mentioned activity, by for example expression either in the cytosol or in an organelle such as a plastid or mitochondria or both, preferably in plastids while increasing the amount of protein, activity or function of said functional equivalent in an organism, e.g. a microorganism, a plant or plant tissue or animal tissue, plant or animal cells or a part of the same.

A nucleic acid molecule encoding an homologous to a protein sequence of table II, application no. 1, columns 5 and 7 can be created by introducing one or more nucleotide substitutions, additions or deletions into a nucleotide sequence of the nucleic acid molecule of the present invention, in particular of table I, application no. 1, columns 5 and 7 such that one or more amino acid substitutions, additions or deletions are introduced into the encoded protein. Mutations can be introduced into the encoding sequences of table I, application no. 1, columns 5 and 7 by standard techniques, such as site-directed mutagenesis and PCR-mediated mutagenesis.

Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophane), beta-branched side chains (e.g., threonine, valine, isoleucine) and aromatic side chains (e.g., tyrosine, phenylalanine, tryptophane, histidine).

Thus, a predicted nonessential amino acid residue in a polypeptide of the invention or a polypeptide used in the process of the invention is preferably replaced with another amino acid residue from the same family. Alternatively, in another embodiment, mutations can be introduced randomly along all or part of a coding sequence of a nucleic acid molecule of the invention or used in the process of the invention, such as by saturation mutagenesis, and the resultant mutants can be screened for activity described herein to identify mutants that retain or even have increased above mentioned activity, e.g. conferring an enhanced NUE and/or increased biomass production as compared to a corresponding non-transformed wild type plant cell, plant or part thereof.

Following mutagenesis of one of the sequences as shown herein, the encoded protein can be expressed recombinant and the activity of the protein can be determined using, for example, assays described herein (see Examples).

The highest homology of the nucleic acid molecule used in the process according to the invention was found for the following database entries by Gap search.

Homologues of the nucleic acid sequences used, with the sequence shown in table I, application no. 1, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, application no. 1, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, application no. 1, columns 5 and 7. It is preferred that the nucleic acid molecule comprises as little as possible other nucleotides not shown in any one of table I, application no. 1, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, application no. 1, columns 5 and 7.

Also preferred is that the nucleic acid molecule used in the process of the invention encodes a polypeptide comprising the sequence shown in table II, application no. 1, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, application no. 1, columns 5 and 7.

In one embodiment, the nucleic acid molecule of the invention or used in the process encodes a polypeptide comprising the sequence shown in table II, application no. 1, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, application no. 1, columns 5 and 7.

Polypeptides (=proteins), which still have the essential biological or enzymatic activity of the polypeptide of the present invention conferring an increased yield, especially an enhanced NUE and/or increased biomass production, as compared to a corresponding non-transformed wild type plant cell, plant or part thereof i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, application no. 1, columns 5 and 7 expressed under identical conditions.

Homologues of table I, application no. 1, columns 5 and 7 or of the derived sequences of table II, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'-regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

In addition to the nucleic acid molecules encoding the NUERPs described above, another aspect of the invention pertains to negative regulators of the activity of a nucleic acid molecules selected from the group according to table I, application no. 1, column 5 and/or 7, preferably column 7. Antisense polynucleotides thereto are thought to inhibit the downregulating activity of those negative regulators by specifically binding the target polynucleotide and interfering with transcription, splicing, transport, translation, and/or stability of the target polynucleotide. Methods are described in the prior art for targeting the antisense polynucleotide to the chromosomal DNA, to a primary RNA transcript, or to a processed mRNA. Preferably, the target regions include splice sites, translation initiation codons, translation termination codons, and other sequences within the open reading frame.

The term "antisense," for the purposes of the invention, refers to a nucleic acid comprising a polynucleotide that is sufficiently complementary to all or a portion of a gene, primary transcript, or processed mRNA, so as to interfere with expression of the endogenous gene. "Complementary" polynucleotides are those that are capable of base pairing according to the standard Watson-Crick complementarity rules. Specifically, purines will base pair with pyrimidines to form a combination of guanine paired with cytosine (G:C) and adenine paired with either thymine (A:T) in the case of DNA, or adenine paired with uracil (A:U) in the case of RNA. It is understood that two polynucleotides may hybridize to each other even if they are not completely complementary to each other, provided that each has at least one region that is substantially complementary to the other. The term "antisense nucleic acid" includes single stranded RNA as well as double-stranded DNA expression cassettes that can be transcribed to produce an antisense RNA. "Active" antisense nucleic acids are antisense RNA molecules that are capable of selectively hybridizing with a negative regulator of the activity of a nucleic acid molecules encoding a polypeptide having at least 80% sequence identity with the polypeptide selected from the group according to table II, application no. 1, column 5 and/or 7, preferably column 7.

The antisense nucleic acid can be complementary to an entire negative regulator strand, or to only a portion thereof. In an embodiment, the antisense nucleic acid molecule is antisense to a "noncoding region" of the coding strand of a nucleotide sequence encoding a NUERP. The term "noncoding region" refers to 5' and 3' sequences that flank the coding region that are not translated into amino acids (i.e., also referred to as 5' and 3' untranslated regions). The antisense nucleic acid molecule can be complementary to only a portion of the noncoding region of NUERP mRNA. For example, the antisense oligonucleotide can be complementary to the region surrounding the translation start site of NUERP mRNA. An antisense oligonucleotide can be, for example, about 5, 10, 15, 20, 25, 30, 35, 40, 45 or 50 nucleotides in length. Typically, the antisense molecules of the present invention comprise an RNA having 60-100% sequence identity with at least 14 consecutive nucleotides of a noncoding region of one of the nucleic acid of table I. Preferably, the sequence identity will be at least 70%, more preferably at least 75%, 80%, 85%, 90%, 95%, 98% and most preferably 99%.

An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl)-uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, 5-methyl-2-thiouracil, 3-(3-amino-3-N-2-carboxypropyl)-uracil, acp3 and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

In yet another embodiment, the antisense nucleic acid molecule of the invention is an alpha-anomeric nucleic acid molecule. An alpha-anomeric nucleic acid molecule forms specific double-stranded hybrids with complementary RNA in which, contrary to the usual b-units, the strands run parallel to each other (Gaultier et al., Nucleic Acids. Res. 15, 6625 (1987)). The antisense nucleic acid molecule can also comprise a 2'-o-methylribonucleotide (Inoue et al., Nucleic Acids Res. 15, 6131 (1987)) or a chimeric RNA-DNA analogue (Inoue et al., FEBS Lett. 215, 327 (1987)).

The antisense nucleic acid molecules of the invention are typically administered to a cell or generated in situ such that they hybridize with or bind to cellular mRNA and/or genomic DNA. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic (including plant) promoter are preferred.

As an alternative to antisense polynucleotides, ribozymes, sense polynucleotides, or double stranded RNA (dsRNA) can be used to reduce expression of a NUERP polypeptide. By "ribozyme" is meant a catalytic RNA-based enzyme with ribonuclease activity which is capable of cleaving a single-stranded nucleic acid, such as an mRNA, to which it has a complementary region. Ribozymes (e.g., hammerhead ribozymes described in Haselhoff and Gerlach, Nature 334, 585 (1988)) can be used to catalytically cleave NUERP mRNA transcripts to thereby inhibit translation of NUERP mRNA. A ribozyme having specificity for a NUERP-encoding nucleic acid can be designed based upon the nucleotide sequence of a NUERP cDNA, as disclosed herein or on the basis of a heterologous sequence to be isolated according to methods taught in this invention. For example, a derivative of a Tetrahymena L-19 IVS RNA can be constructed in which the nucleotide sequence of the active site is complementary to the nucleotide sequence to be cleaved in a NUERP-encoding mRNA. See, e.g. U.S. Pat. Nos. 4,987,071 and 5,116,742 to Cech et al. Alternatively, NUERP mRNA can be used to select a catalytic RNA having a specific ribonuclease activity from a pool of RNA molecules. See, e.g. Bartel D., and Szostak J. W., Science 261, 1411 (1993). In preferred embodiments, the ribozyme will contain a portion having at least 7, 8, 9, 10, 12, 14, 16, 18 or 20 nucleotides, and more preferably 7 or 8 nucleotides, that have 100% complementarity to a portion of the target RNA. Methods for making ribozymes are known to those skilled in the art. See, e.g. U.S. Pat. Nos. 6,025,167, 5,773,260 and 5,496,698.

The term "dsRNA," as used herein, refers to RNA hybrids comprising two strands of RNA. The dsRNAs can be linear or circular in structure. In a preferred embodiment, dsRNA is specific for a polynucleotide encoding either the polypeptide according to table II or a polypeptide having at least 70% sequence identity with a polypeptide according to table II. The hybridizing RNAs may be substantially or completely complementary. By "substantially complementary," is meant that when the two hybridizing RNAs are optimally aligned using the BLAST program as described above, the hybridizing portions are at least 95% complementary. Preferably, the dsRNA will be at least 100 base pairs in length. Typically, the hybridizing RNAs will be of identical length with no over hanging 5' or 3' ends and no gaps. However, dsRNAs having 5' or 3' overhangs of up to 100 nucleotides may be used in the methods of the invention.

The dsRNA may comprise ribonucleotides or ribonucleotide analogs, such as 2'-O-methyl ribosyl residues, or combinations thereof. See, e.g. U.S. Pat. Nos. 4,130,641 and 4,024,222. A dsRNA polyriboinosinic acid:polyribocytidylic acid is described in U.S. Pat. No. 4,283,393. Methods for making and using dsRNA are known in the art. One method comprises the simultaneous transcription of two complementary DNA strands, either in vivo, or in a single in vitro reaction mixture. See, e.g. U.S. Pat. No. 5,795,715. In one embodiment, dsRNA can be introduced into a plant or plant cell directly by standard transformation procedures. Alternatively, dsRNA can be expressed in a plant cell by transcribing two complementary RNAs.

Other methods for the inhibition of endogenous gene expression, such as triple helix formation (Moser et al., Science 238, 645 (1987), and Cooney et al., Science 241, 456 (1988)) and cosuppression (Napoli et al., The Plant Cell 2, 279, 1990,) are known in the art. Partial and full-length cDNAs have been used for the cosuppression of endogenous plant genes. See, e.g. U.S. Pat. Nos. 4,801,340, 5,034,323, 5,231,020, and 5,283,184; Van der Kroll et al., The Plant Cell 2, 291, (1990); Smith et al., Mol. Gen. Genetics 224, 477 (1990), and Napoli et al., The Plant Cell 2, 279 (1990).

For sense suppression, it is believed that introduction of a sense polynucleotide blocks transcription of the corresponding target gene. The sense polynucleotide will have at least 65% sequence identity with the target plant gene or RNA. Preferably, the percent identity is at least 80%, 90%, 95% or more. The introduced sense polynucleotide need not be full length relative to the target gene or transcript. Preferably, the sense polynucleotide will have at least 65% sequence identity with at least 100 consecutive nucleotides of one of the nucleic acids as depicted in table I, application no. 1. The regions of identity can comprise introns and/or exons and untranslated regions. The introduced sense polynucleotide may be present in the plant cell transiently, or may be stably integrated into a plant chromosome or extrachromosomal replicon.

Further, object of the invention is an expression vector comprising a nucleic acid molecule comprising a nucleic acid molecule selected from the group consisting of:

(a) a nucleic acid molecule encoding the polypeptide shown in column 5 or 7 of table II, application no. 1;

(b) a nucleic acid molecule shown in column 5 or 7 of table I, application no. 1;

(c) a nucleic acid molecule, which, as a result of the degeneracy of the genetic code, can be derived from a polypeptide sequence depicted in column 5 or 7 of table II, application no. 1, and confers an increased yield, especially an enhanced NUE and/or increased biomass production, as compared to a corresponding non-transformed wild type plant cell, a plant or a part thereof;

(d) a nucleic acid molecule having at least 30% identity, preferably at least 40%, 50%, 60%, 70%, 75%, 80%, 85%, 90%, 95%, 96%, 97%, 98%, 99%, 99.5% with the nucleic acid molecule sequence of a polynucleotide comprising the nucleic acid molecule shown in column 5 or 7 of table I, application no. 1, and confers an increased yield, especially an enhanced NUE and/or increased biomass production, as compared to a corresponding non-transformed wild type plant cell, a plant or a part thereof;

(e) a nucleic acid molecule encoding a polypeptide having at least 30% identity, preferably at least 40%, 50%, 60%, 70%, 75%, 80%, 85%, 90%, 95%, 96%, 97%, 98%, 99%, 99.5%, with the amino acid sequence of the polypeptide encoded by the nucleic acid molecule of (a), (b), (c) or (d) and having the activity represented by a nucleic acid molecule comprising a polynucleotide as depicted in column 5 of table I, application no. 1, and confers an increased yield, especially an enhanced NUE and/or increased biomass production, as compared to a corresponding non-transformed wild type plant cell, a plant or a part thereof;
(f) nucleic acid molecule which hybridizes with a nucleic acid molecule of (a), (b),
(c), (d) or (e) under stringent hybridization conditions and confers an increased yield, especially an enhanced NUE and/or increased biomass production, as compared to a corresponding non-transformed wild type plant cell, a plant or a part thereof;
(g) a nucleic acid molecule encoding a polypeptide which can be isolated with the aid of monoclonal or polyclonal antibodies made against a polypeptide encoded by one of the nucleic acid molecules of (a), (b), (c), (d), (e) or (f) and having the activity represented by the nucleic acid molecule comprising a polynucleotide as depicted in column 5 of table I, application no. 1;
(h) a nucleic acid molecule encoding a polypeptide comprising the consensus sequence or one or more polypeptide motifs as shown in column 7 of table IV, application no. 1, and preferably having the activity represented by a protein molecule comprising a polypeptide as depicted in column 5 of table II or IV, application no. 1;
(i) a nucleic acid molecule encoding a polypeptide having the activity represented by a protein as depicted in column 5 of table II, application no. 1, and confers an increased yield, especially an enhanced NUE and/or increased biomass production, as compared to a corresponding non-transformed wild type plant cell, a plant or a part thereof;
(j) nucleic acid molecule which comprises a polynucleotide, which is obtained by amplifying a cDNA library or a genomic library using the primers in column 7 of table III, application no. 1, (which ion a special embodiment do not start at their 5'-end with the nucleotides ATA and) preferably having the activity represented by a protein molecule comprising a polypeptide as depicted in column 5 of table II or IV, application no. 1;
and
(k) a nucleic acid molecule which is obtainable by screening a suitable nucleic acid library, especially a cDNA library and/or a genomic library, under stringent hybridization conditions with a probe comprising a complementary sequence of a nucleic acid molecule of (a) or (b) or with a fragment thereof, having at least 15 nt, preferably 20 nt, 30 nt, 50 nt, 100 nt, 200 nt, 500 nt, 750 or 1000 nt of a nucleic acid molecule complementary to a nucleic acid molecule sequence characterized in (a) to (e) and encoding a polypeptide having the activity represented by a protein comprising a polypeptide as depicted in column 5 of table II, application no. 1.

The invention further provides an isolated recombinant expression vector comprising a NUERP encoding nucleic acid as described above, wherein expression of the vector or NUERP encoding nucleic acid, respectively in a host cell results in enhanced NUEas compared to the corresponding non-transformed wild type of the host cell. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Further types of vectors can be linearized nucleic acid sequences, such as transposons, which are pieces of DNA which can copy and insert themselves. There have been 2 types of transposons found: simple transposons, known as Insertion Sequences and composite transposons, which can have several genes as well as the genes that are required for transposition.

Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

A plant expression cassette preferably contains regulatory sequences capable of driving gene expression in plant cells and operably linked so that each sequence can fulfill its function, for example, termination of transcription by polyadenylation signals. Preferred polyadenylation signals are those originating from *Agrobacterium tumefaciens* T-DNA such as the gene 3 known as octopine synthase of the Tiplasmid pTiACH5 (Gielen et al., EMBO J. 3, 835 1(984)) or functional equivalents thereof but also all other terminators functionally active in plants are suitable.

As plant gene expression is very often not limited on transcriptional levels, a plant expression cassette preferably contains other operably linked sequences like translational enhancers such as the overdrive-sequence containing the 5"-untranslated leader sequence from tobacco mosaic virus enhancing the protein per RNA ratio (Gallie et al., Nucl. Acids Research 15, 8693 (1987)).

Plant gene expression has to be operably linked to an appropriate promoter conferring gene expression in a timely, cell or tissue specific manner. Preferred are promoters driving constitutive expression (Benfey et al., EMBO J. 8, 2195 (1989)) like those derived from plant viruses like the $^{35}$S CaMV (Franck et al., Cell 21, 285 (1980)), the 19S CaMV (see also U.S. Pat. No. 5,352,605 and PCT Application No. WO 84/02913) or plant promoters like those from Rubisco small subunit described in U.S. Pat. No. 4,962,028.

Additional advantageous regulatory sequences are, for example, included in the plant promoters such as CaMV/35S (Franck et al., Cell 21 285 (1980)), PRP1 (Ward et al., Plant. Mol. Biol. 22, 361 (1993)), SSU, OCS, lib4, usp, STLS1, B33, LEB4, nos, ubiquitin, napin or phaseolin promoter. Also advantageous in this connection are inducible promoters such as the promoters described in EP 388 186 (benzyl sulfonamide inducible), Gatz et al., Plant J. 2, 397 (1992) (tetracyclin inducible), EP-A-0 335 528 (abscisic acid inducible) or WO 93/21334 (ethanol or cyclohexenol inducible). Additional useful plant promoters are the cytosolic FBPase promotor or ST-LSI promoter of potato (Stockhaus et al., EMBO J. 8, 2445 (1989)), the phosphorybosyl phyrophshate amido transferase promoter of *Glycine max* (gene bank accession No. U87999) or the noden specific promoter described in EP-A-0 249 676. Additional particularly advantageous promoters are seed specific promoters which can be used for monocotyledones or dicotyledones and are described in U.S. Pat. No. 5,608,152 (napin promoter from rapeseed), WO 98/45461 (phaseolin promoter from *Arabidopsis*), U.S. Pat. No. 5,504,200 (phaseolin promoter from *Phaseolus vulgaris*), WO 91/13980 (Bce4 promoter from *Brassica*) and Baeumlein et al., Plant J., 2 (2), 233 (1992) (LEB4 promoter from leguminosa). Said promoters are useful in dicotyledones. The following promoters are useful for example in monokcotyledones Ipt-2- or Ipt-1-promoter from barley (WO 95/15389 and WO 95/23230) or hordein promoter from barley. Other useful promoters are described in WO 99/16890.

It is possible in principle to use all natural promoters with their regulatory sequences like those mentioned above for the novel process. It is also possible and advantageous in addition to use synthetic promoters.

The gene construct may also comprise further genes which are to be inserted into the organisms and which are for example involved in stress resistance and biomass production increase. It is possible and advantageous to insert and express in host organisms regulatory genes such as genes for inducers, repressors or enzymes which intervene by their enzymatic activity in the regulation, or one or more or all genes of a biosynthetic pathway. These genes can be heterologous or homologous in origin. The inserted genes may have their own promotor or else be under the control of same promoter as the sequences of the nucleic acid of table I or their homologs. The gene construct advantageously comprises, for expression of the other genes present, additionally 3' and/or 5' terminal regulatory sequences to enhance expression, which are selected for optimal expression depending on the selected host organism and gene or genes.

These regulatory sequences are intended to make specific expression of the genes and protein expression possible as mentioned above. This may mean, depending on the host organism, for example that the gene is expressed or overexpressed only after induction, or that it is immediately expressed and/or overexpressed.

The regulatory sequences or factors may moreover preferably have a beneficial effect on expression of the introduced genes, and thus increase it. It is possible in this way for the regulatory elements to be enhanced advantageously at the transcription level by using strong transcription signals such as promoters and/or enhancers. However, in addition, it is also possible to enhance translation by, for example, improving the stability of the mRNA.

Other preferred sequences for use in plant gene expression cassettes are targeting-sequences necessary to direct the gene product in its appropriate cell compartment (for review see Kermode, Crit. Rev. Plant Sci. 15 (4), 285 (1996) and references cited therein) such as the vacuole, the nucleus, all types of plastids like amyloplasts, chloroplasts, chromoplasts, the extracellular space, mitochondria, the endoplasmic reticulum, oil bodies, peroxisomes and other compartments of plant cells. Plant gene expression can also be facilitated via an inducible promoter (for review see Gatz, Annu. Rev. Plant Physiol. Plant Mol. Biol. 48, 89 (1997)). Chemically inducible promoters are especially suitable if gene expression is wanted to occur in a time specific manner.

Table VI lists several examples of promoters that may be used to regulate transcription of the NUE related protein nucleic acid coding sequences.

TABLE VI

Examples of tissue-specific and inducible promoters in plants

| Expression | Reference |
|---|---|
| Cor78- Cold, drought, salt, ABA, wounding-inducible | Ishitani, et al., Plant Cell 9, 1935 (1997), Yamaguchi-Shinozaki and Shinozaki, Plant Cell 6, 251 (1994) |
| Rci2A - Cold, dehydration-inducible | Capel et al., Plant Physiol 115, 569 (1997) |
| Rd22 - Drought, salt | Yamaguchi-Shinozaki and Shinozaki, Mol. Gen. Genet 238, 17 (1993) |
| Cor15A- Cold, dehydration, ABA | Baker et al., Plant Mol. Biol. 24, 701 (1994) |
| GH3- Auxin inducible | Liu et al., Plant Cell 6, 645 (1994) |
| ARSK1-Root, salt inducible | Hwang and Goodman, Plant J. 8, 37 (1995) |
| PtxA - Root, salt inducible | GenBank accession X67427 |
| SbHRGP3 - Root specific | Ahn et al., Plant Cell 8, 1477 (1998). |
| KST1 - Guard cell specific | Plesch et al., Plant Journal. 28(4): 455- (2001) |
| KAT1 - Guard cell specific | Plesch et al., Gene 249, 83 (2000), Nakamura et al., Plant Physiol. 109, 371 (1995) |
| salicylic acid inducible | PCT Application No. WO 95/19443 |
| tetracycline inducible | Gatz et al. Plant J. 2, 397 (1992) |
| Ethanol inducible | PCT Application No. WO 93/21334 |
| Pathogen inducible PRP1 | Ward et al., Plant. Mol. Biol. 22, 361 -(1993) |
| Heat inducible hsp80 | U.S. Pat. No. 5,187,267 |
| Cold inducible alpha-amylase | PCT Application No. WO 96/12814 |
| Wound-inducible pinII | European Patent No. 375 091 |
| RD29A - salt-inducible | Yamaguchi-Shinozalei et al. Mol. Gen. Genet. 236, 331 (1993) |
| Plastid-specific viral RNA-polymerase | PCT Application No. WO 95/16783, PCT Application WO 97/06250 |

Other promotors, e.g. superpromoter (Ni et al., Plant Journal 7, 661 (1995)), Ubiquitin promotor (Callis et al., J. Biol. Chem., 265, 12486 (1990); U.S. Pat. Nos. 5,510,474; 6,020, 190; Kawalleck et al., Plant. Molecular Biology, 21, 673 (1993)) or 34S promotor (GenBank Accession numbers M59930 and X16673) were similar useful for the present invention and are known to a person skilled in the art.

Developmental stage-preferred promoters are preferentially expressed at certain stages of development. Tissue and organ preferred promoters include those that are preferentially expressed in certain tissues or organs, such as leaves, roots, seeds, or xylem. Examples of tissue preferred and organ preferred promoters include, but are not limited to fruit-preferred, ovule-preferred, male tissue-preferred, seed-preferred, integument-preferred, tuber-preferred, stalk-preferred, pericarp-preferred, and leafpreferred, stigma-preferred, pollen-preferred, anther-preferred, a petal-preferred, sepal-preferred, pedicel-preferred, silique-preferred, stem-preferred, root-preferred promoters, and the like. Seed preferred promoters are preferentially expressed during seed development and/or germination. For example, seed preferred promoters can be embryo-preferred, endosperm preferred, and seed coat-preferred. See Thompson et al., BioEssays 10, 108 (1989). Examples of seed preferred promoters include, but are not limited to, cellulose synthase (celA), Cim1, gamma-zein, globulin-1, maize 19 kD zein (cZ19B1), and the like.

Other promoters useful in the expression cassettes of the invention include, but are not limited to, the major chlorophyll a/b binding protein promoter, histone promoters, the Ap3 promoter, the β-conglycin promoter, the napin promoter, the soybean lectin promoter, the maize 15 kD zein promoter, the 22 kD zein promoter, the 27 kD zein promoter, the g-zein promoter, the waxy, shrunken 1, shrunken 2 and bronze promoters, the Zm13 promoter (U.S. Pat. No. 5,086,169), the maize polygalacturonase promoters (PG) (U.S. Pat. Nos. 5,412,085 and 5,545,546), and the SGB6 promoter (U.S. Pat. No. 5,470,359), as well as synthetic or other natural promoters.

Additional flexibility in controlling heterologous gene expression in plants may be obtained by using DNA binding domains and response elements from heterologous sources (i.e., DNA binding domains from non-plant sources). An example of such a heterologous DNA binding domain is the LexA DNA binding domain (Brent and Ptashne, Cell 43, 729 (1985)).

The invention further provides a recombinant expression vector comprising a NUERP DNA molecule of the invention cloned into the expression vector in an antisense orientation. That is, the DNA molecule is operatively linked to a regulatory sequence in a manner that allows for expression (by transcription of the DNA molecule) of an RNA molecule that is antisense to a NUERP mRNA. Regulatory sequences operatively linked to a nucleic acid molecule cloned in the antisense orientation can be chosen which direct the continuous expression of the antisense RNA molecule in a variety of cell types. For instance, viral promoters and/or enhancers, or regulatory sequences can be chosen which direct constitutive, tissue specific, or cell type specific expression of antisense RNA. The antisense expression vector can be in the form of a recombinant plasmid, phagemid, or attenuated virus wherein antisense nucleic acids are produced under the control of a high efficiency regulatory region. The activity of the regulatory region can be determined by the cell type into which the vector is introduced. For a discussion of the regulation of gene expression using antisense genes, see Weintraub H. et al., Reviews—Trends in Genetics, Vol. 1(1), 23 (1986) and Mol et al., FEBS Letters 268, 427 (1990).

Another aspect of the invention pertains to isolated NUERPs, and biologically active portions thereof. An "isolated" or "purified" polypeptide or biologically active portion thereof is free of some of the cellular material when produced by recombinant DNA techniques, or chemical precursors or other chemicals when chemically synthesized. The language "substantially free of cellular material" includes preparations of NUERP in which the polypeptide is separated from some of the cellular components of the cells in which it is naturally or recombinantly produced. In one embodiment, the language "substantially free of cellular material" includes preparations of a NUERP having less than about 30% (by dry weight) of non-NUERP material (also referred to herein as a "contaminating polypeptide"), more preferably less than about 20% of non-NUERP material, still more preferably less than about 10% of non-NUERP material, and most preferably less than about 5% non-NUERP material.

When the NUERP or biologically active portion thereof is recombinantly produced, it is also preferably substantially free of culture medium, i.e., culture medium represents less than about 20%, more preferably less than about 10%, and most preferably less than about 5% of the volume of the polypeptide preparation. The language "substantially free of chemical precursors or other chemicals" includes preparations of NUERP in which the polypeptide is separated from chemical precursors or other chemicals that are involved in the synthesis of the polypeptide. In one embodiment, the language "substantially free of chemical precursors or other chemicals" includes preparations of a NUERP having less than about 30% (by dry weight) of chemical precursors or non-NUERP chemicals, more preferably less than about 20% chemical precursors or non-NUERP chemicals, still more preferably less than about 10% chemical precursors or non-NUERP chemicals, and most preferably less than about 5% chemical precursors or non-NUERP chemicals. In preferred embodiments, isolated polypeptides, or biologically active portions thereof, lack contaminating polypeptides from the same organism from which the NUERP is derived. Typically, such polypeptides are produced by recombinant expression of, for example, a Saccharomyces cerevisiae, E. coli or Brassica napus, Glycine max, Zea mays or Oryza sativa NUERP, in an microorganism like Saccharomyces cerevisiae, E. coli, C. glutamicum, ciliates, algae, fungi or plants, provided that the polypeptide is recombinant expressed in an organism being different to the original organism.

The nucleic acid molecules, polypeptides, polypeptide homologs, fusion polypeptides, primers, vectors, and host cells described herein can be used in one or more of the following methods: identification of Saccharomyces cerevisiae, E. coli or Brassica napus, Glycine max, Zea mays or Oryza sativa and related organisms; mapping of genomes of organisms related to Saccharomyces cerevisiae, E. coli; identification and localization of Saccharomyces cerevisiae, E. coli or Brassica napus, Glycine max, Zea mays or Oryza sativa sequences of interest; evolutionary studies; determination of NUERP regions required for function; modulation of a NUERP activity; modulation of the metabolism of one or more cell functions; modulation of the trans-membrane transport of one or more compounds; modulation of the enhancement of yield, especially of the NUE and/or biomass production; and modulation of expression of NUERP nucleic acids.

The NUERP nucleic acid molecules of the invention are also useful for evolutionary and polypeptide structural studies. The metabolic and transport processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the polypeptide that are essential for the functioning of the enzyme. This type of determination is of value for polypeptide engineering studies and may give an indication of what the polypeptide can tolerate in terms of mutagenesis without losing function.

Manipulation of the NUERP nucleic acid molecules of the invention may result in the production of NUERPs having functional differences from the wild-type NUERPs. These polypeptides may be improved in efficiency or activity, may be present in greater numbers in the cell than is usual, or may be decreased in efficiency or activity.

There are a number of mechanisms by which the alteration of a NUERP of the invention may directly affect the yield, especially the NUE and/or biomass production. In the case of plants expressing NUERPs, increased transport can lead to increased yield, especially an increased NUE and/or biomass production. By either increasing the number or the activity of transporter molecules which transport and distribute nitrogen compounds or transport forms thereof, it may be possible to affect the nitrogen use efficiency.

The effect of the genetic modification in plants regarding the enhanced yield, particularly due to one or more improved yield related traits as defined above, especially the NUE, can be assessed by growing the modified plant under less than suitable conditions and then analyzing the growth characteristics and/or metabolism of the plant. Such analysis techniques are well known to one skilled in the art, and include dry weight, fresh weight, polypeptide synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, Vol. 17; Rehm et al., 1993 Biotechnology, Vol. 3, Chapter III: Product recovery and purification, page 469-714, VCH: Weinheim; Better P. A. et al., 1988, Bioseparations: downstream processing for biotechnology, John Wiley and Sons; Kennedy J. F., and Cabral J. M. S., 1992, Recovery processes for biological materials, John Wiley and Sons; Shaeiwitz J. A. and Henry J. D., 1988, Biochemical separations, in Ulmann's Encyclopedia of Industrial Chemistry, Vol. B3, Chapter 11, page 1-27, VCH: Weinheim; and Dechow F. J., 1989, Separation and purification techniques in biotechnology, Noyes Publications).

For example, yeast expression vectors comprising the nucleic acids disclosed herein, or fragments thereof, can be constructed and transformed into *Saccharomyces cerevisiae* using standard protocols. The resulting transgenic cells can then be assayed for generation or alteration of their yield, particularly NUE and/or biomass production. Similarly, plant expression vectors comprising the nucleic acids disclosed herein, or fragments thereof, can be constructed and transformed into an appropriate plant cell such as *Arabidopsis*, soy, rape, maize, cotton, rice, wheat, *Medicago truncatula*, etc., using standard protocols. The resulting transgenic cells and/or plants derived therefrom can then be assayed for yield increase, especially for generation or alteration of their NUE and/or biomass production.

The engineering of one or more genes according to table I and coding for the NUERP of table II of the invention may also result in NUERPs having altered activities which indirectly and/or directly impact yield, especially the NUE of algae, plants, ciliates, fungi, or other microorganisms like *C. glutamicum*.

Additionally, the sequences disclosed herein, or fragments thereof, can be used to generate knockout mutations in the genomes of various organisms, such as bacteria, mammalian cells, yeast cells, and plant cells (Girke, T., The Plant Journal 15, 39 (1998)). The resultant knockout cells can then be evaluated for their ability or capacity to tolerate N-limited conditions for their growth, their response to various N-limited growth conditions, and the effect on the phenotype and/or genotype of the mutation. For other methods of gene inactivation, see U.S. Pat. No. 6,004,804 and Puttaraju et al., Nature Biotechnology 17, 246 (1999).

The aforementioned mutagenesis strategies for NUERPs resulting in increased yield, especially in enhanced NUE and/or increased biomass production, are not meant to be limiting; variations on these strategies will be readily apparent to one skilled in the art. Using such strategies, and incorporating the mechanisms disclosed herein, the nucleic acid and polypeptide molecules of the invention may be utilized to generate algae, ciliates, plants, fungi, or other microorganisms like *C. glutamicum* expressing mutated NUERP nucleic acid and polypeptide molecules such that the yield, especially the NUE and/or biomass production, is improved.

The present invention also provides antibodies that specifically bind to a NUERP, or a portion thereof, as encoded by a nucleic acid described herein. Anti-bodies can be made by many well-known methods (see, e.g. Harlow and Lane, "Antibodies; A Laboratory Manual", Cold Spring Harbor Laboratory, Cold Spring Harbor, N.Y., (1988)). Briefly, purified antigen can be injected into an animal in an amount and in intervals sufficient to elicit an immune response. Antibodies can either be purified directly, or spleen cells can be obtained from the animal. The cells can then fused with an immortal cell line and screened for antibody secretion. The antibodies can be used to screen nucleic acid clone libraries for cells secreting the antigen. Those positive clones can then be sequenced. See, for example, Kelly et al., Bio/Technology 10, 163 (1992); Bebbington et al., Bio/Technology 10, 169 (1992).

The phrases "selectively binds" and "specifically binds" with the polypeptide refer to a binding reaction that is determinative of the presence of the polypeptide in a heterogeneous population of polypeptides and other biologics. Thus, under designated immunoassay conditions, the specified antibodies bound to a particular polypeptide do not bind in a significant amount to other polypeptides present in the sample. Selective binding of an antibody under such conditions may require an antibody that is selected for its specificity for a particular polypeptide. A variety of immunoassay formats may be used to select antibodies that selectively bind with a particular polypeptide. For example, solid-phase ELISA immunoassays are routinely used to select antibodies selectively immunoreactive with a polypeptide. See Harlow and Lane, "Antibodies, A Laboratory Manual," Cold Spring Harbor Publications, New York, (1988), for a description of immunoassay formats and conditions that could be used to determine selective binding.

In some instances, it is desirable to prepare monoclonal antibodies from various hosts. A description of techniques for preparing such monoclonal antibodies may be found in Stites et al., eds., "Basic and Clinical Immunology," (Lange Medical Publications, Los Altos, Calif., Fourth Edition) and references cited therein, and in Harlow and Lane, "Antibodies, A Laboratory Manual," Cold Spring Harbor Publications, New York, (1988).

Gene expression in plants is regulated by the interaction of protein transcription factors with specific nucleotide sequences within the regulatory region of a gene. One example of transcription factors are polypeptides that contain zinc finger (ZF) motifs. Each ZF module is approximately 30 amino acids long folded around a zinc ion. The DNA recognition domain of a ZF protein is a α-helical structure that inserts into the major grove of the DNA double helix. The module contains three amino acids that bind to the DNA with each amino acid contacting a single base pair in the target DNA sequence. ZF motifs are arranged in a modular repeating fashion to form a set of fingers that recognize a contiguous DNA sequence. For example, a threefingered ZF motif will recognize 9 by of DNA. Hundreds of proteins have been shown to contain ZF motifs with between 2 and 37 ZF modules in each protein (Isalan M. et al., Biochemistry 37 (35), 12026 (1998); Moore M. et al., Proc. Natl. Acad. Sci. USA 98 (4), 1432 (2001) and Moore M. et al., Proc. Natl. Acad. Sci. USA 98 (4), 1437 (2001); U.S. Pat. Nos. 6,007,988 and 6,013,453).

The regulatory region of a plant gene contains many short DNA sequences (cis-acting elements) that serve as recognition domains for transcription factors, including ZF proteins. Similar recognition domains in different genes allow the coordinate expression of several genes encoding enzymes in a metabolic pathway by common transcription factors. Variation in the recognition domains among members of a gene family facilitates differences in gene expression within the same gene family, for example, among tissues and stages of development and in response to environmental conditions. Typical ZF proteins contain not only a DNA recognition domain but also a functional domain that enables the ZF protein to activate or repress transcription of a specific gene. Experimentally, an activation domain has been used to activate transcription of the target gene (U.S. Pat. No. 5,789,538 and patent application WO 95/19431), but it is also possible to link a transcription repressor domain to the ZF and thereby inhibit transcription (patent applications WO 00/47754 and WO 01/002019). It has been reported that an enzymatic function such as nucleic acid cleavage can be linked to the ZF (patent application WO 00/20622).

The invention provides a method that allows one skilled in the art to isolate the regulatory region of one or more NUERP encoding genes from the genome of a plant cell and to design zinc finger transcription factors linked to a functional domain that will interact with the regulatory region of the gene. The interaction of the zinc finger protein with the plant gene can be designed in such a manner as to alter expression of the gene and preferably thereby to confer increased yield, especially enhanced NUE and/or increased biomass production.

In particular, the invention provides a method of producing a transgenic plant with a NUERP coding nucleic acid, wherein expression of the nucleic acid(s) in the plant results in increased yield, especially in enhanced NUE and/or increased biomass production, as compared to a wild type plant comprising: (a) transforming a plant cell with an expression vector comprising a NUERP encoding nucleic acid, and (b) generating from the plant cell a transgenic plant with enhanced NUE and/or increased biomass production as compared to a wild type plant. For such plant transformation, binary vectors such as pBinAR can be used (Hofgen and Willmitzer, Plant Science 66, 221 (1990)). Moreover suitable binary vectors are for example pBIN19, pBI101, pGPTV or pPZP (Hajukiewicz P. et al., Plant Mol. Biol., 25, 989 (1994)).

Construction of the binary vectors can be performed by ligation of the cDNA into the T-DNA. 5' to the cDNA a plant promoter activates transcription of the cDNA. A polyadenylation sequence is located 3' to the cDNA. Tissue-specific expression can be achieved by using a tissue specific promoter as listed above. Also, any other promoter element can be used. For constitutive expression within the whole plant, the CaMV 35S promoter can be used. The expressed protein can be targeted to a cellular compartment using a signal peptide, for example for plastids, mitochondria or endoplasmic reticulum (Kermode, Crit. Rev. Plant Sci. 4 (15), 285 (1996)). The nucleic acid encoding the signal peptide is cloned 5' in frame to the cDNA to archive subcellular localization of the fusion protein. One skilled in the art will recognize that the promoter used should be operatively linked to the nucleic acid such that the promoter causes transcription of the nucleic acid which results in the synthesis of a mRNA which encodes a polypeptide.

Alternate methods of transfection include the direct transfer of DNA into developing flowers via electroporation or Agrobacterium mediated gene transfer. Agrobacterium mediated plant transformation can be performed using for example the GV3101(pMP90) (Koncz and Schell, Mol. Gen. Genet. 204, 383 (1986)) or LBA4404 (Ooms et al., Plasmid, 7, 15 (1982); Hoekema et al., Nature, 303, 179 (1983)) Agrobacterium tumefaciens strain. Transformation can be performed by standard transformation and regeneration techniques (Deblaere et al., Nucl. Acids. Res. 13, 4777 (1994); Gelvin and Schilperoort, Plant Molecular Biology Manual, $2^{nd}$ Ed.-Dordrecht: Kluwer Academic Publ., 1995.—in Sect., Ringbuc Zentrale Signatur: BT11-P ISBN 0-7923-2731-4; Glick B. R. and Thompson J. E., Methods in Plant Molecular Biology and Biotechnology, Boca Raton: CRC Press, 1993.-360 S., ISBN 0-8493-5164-2). For example, rapeseed can be transformed via cotyledon or hypocotyl transformation (Moloney et al., Plant Cell Reports 8, 238 (1989); De Block et al., Plant Physiol. 91, 694 (1989)). Use of antibiotics for Agrobacterium and plant selection depends on the binary vector and the Agrobacterium strain used for transformation. Rapeseed selection is normally performed using kanamycin as selectable plant marker. Agrobacterium mediated gene transfer to flax can be performed using, for example, a technique described by Mlynarova et al., Plant Cell Report 13, 282 (1994)). Additionally, transformation of soybean can be performed using for example a technique described in European Patent No. 424 047, U.S. Pat. No. 5,322,783, European Patent No. 397 687, U.S. Pat. Nos. 5,376,543 or 5,169,770. Transformation of maize can be achieved by particle bombardment, polyethylene glycol mediated DNA uptake or via the silicon carbide fiber technique (see, for example, Freeling and Walbot "The maize handbook" Springer Verlag: New York (1993) ISBN 3-540-97826-7). A specific example of maize transformation is found in U.S. Pat. No. 5,990,387 and a specific example of wheat transformation can be found in PCT Application No. WO 93/07256.

Growing the modified plants under defined N-conditions, in an especial embodiment under N-limited conditions, and then screening and analyzing the growth characteristics and/or metabolic activity assess the effect of the genetic modification in plants on enhanced NUE and/or increased biomass production. The same applies for the other traits of the present invention, too. Such analysis techniques are well known to one skilled in the art. They include beneath to screening (Römpp Lexikon Biotechnologie, Stuttgart/New York: Georg Thieme Verlag 1992, "screening" p. 701) dry weight, fresh weight, protein synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, Vol. 17; Rehm et al., 1993 Biotechnology, Vol. 3, Chapter III: Product recovery and purification, page 469-714, VCH: Weinheim; Belter, P. A. et al., 1988 Bioseparations: downstream processing for biotechnology, John Wiley and Sons; Kennedy J. F. and Cabral J. M. S., 1992 Recovery processes for biological materials, John Wiley and Sons; Shaeiwitz J. A. and Henry J. D., 1988 Biochemical separations, in: Ullmann's Encyclopedia of Industrial Chemistry, Vol. B3, Chapter 11, page 1-27, VCH: Weinheim; and Dechow F. J. (1989) Separation and purification techniques in biotechnology, Noyes Publications).

In one embodiment, the present invention relates to a method for the identification of a gene product conferring increased nutrient use efficiency and optionally enhanced tolerance to abiotic stress and/or increased yield, in the absence of stress as well as in the absence of nutrient deficiency, especially an enhanced NUE and/or increased biomass production, as compared to a corresponding non-transformed wild type cell in a cell of an organism for example plant, comprising the following steps:

(a) contacting, e.g. hybridizing, some or all nucleic acid molecules of a sample, e.g. cells, tissues, plants or microorganisms or a nucleic acid library, which can contain a candidate gene encoding a gene product conferring increased nutrient use efficiency and optionally enhanced tolerance to abiotic stress and/or increased yield, in the absence of stress as well as in the absence of nutrient deficiency, especially an enhanced NUE efficiency and/or increased biomass, with a nucleic acid molecule as shown in column 5 or 7 of table I A or B, application no. 1, or a functional homologue thereof;

(b) identifying the nucleic acid molecules, which hybridize under relaxed stringent conditions with said nucleic acid molecule, in particular to the nucleic acid molecule sequence shown in column 5 or 7 of table I, application no. 1, and, optionally, isolating the full length cDNA clone or complete genomic clone;

(c) identifying the candidate nucleic acid molecules or a fragment thereof in host cells, preferably in a plant cell;

(d) increasing the expressing of the identified nucleic acid molecules in the host cells for which increased nutrient use efficiency and optionally enhanced tolerance to abiotic stress and/or and/or increased yield, in the absence of stress as well as in the absence of nutrient deficiency, especially an enhanced NUE and/or increased biomass production, are desired;

(e) assaying the level of enhanced NUE and/or increased biomass production of the host cells; and (f) identifying the nucleic acid molecule and its gene product which increased expression confers increased nutrient use efficiency and optionally enhanced tolerance to abiotic stress and/or and/or increased yield, in the absence of stress as well as in the absence of nutrient deficiency, especially an enhanced NUE and/or increased biomass production, in the host cell compared to the wild type.

Relaxed hybridization conditions are: After standard hybridization procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60° to 68° C. with 0.1% SDS. Further examples can be found in the references listed above for the stringend hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridization temperature, washing or hybridization time etc.

In another embodiment, the present invention relates to a method for the identification of a gene product the expression of which confers an increased nutrient use efficiency and optionally enhanced tolerance to abiotic stress and/or and/or increased yield, in the absence of stress as well as in the absence of nutrient deficiency, especially an enhanced NUE and/or increased biomass production, in a cell, comprising the following steps:

(a) identifiying a nucleic acid molecule in an organism, which is at least 20%, preferably 25%, more preferably 30%, even more preferred are 35%. 40% or 50%, even more preferred are 60%, 70% or 80%, most preferred are 90% or 95% or more homolog to the nucleic acid molecule encoding a protein comprising the polypeptide molecule as shown in column 5 or 7 of table II, application no. 1, or comprising a consensus sequence or a polypeptide motif as shown in column 7 of table IV, application no. 1, or being encoded by a nucleic acid molecule comprising a polynucleotide as shown in column 5 or 7 of table I application no. 1, or a homologue thereof as described herein, for example via homology search in a data bank;

(b) enhancing the expression of the identified nucleic acid molecules in the host cells;

(c) assaying the level of increase of nutrient use efficiency and optionally enhancement of tolerance to abiotic stress and/or and/or increase of yield, in the absence of stress as well as in the absence of nutrient deficiency, especially an enhancement of NUE and/or increased biomass production, in the host cells; and (d) identifying the host cell, in which the enhanced expression confers increased nutrient use efficiency and optionally enhanced tolerance to abiotic stress and/or and/or increased yield, in the absence of stress as well as in the absence of nutrient deficiency, especially an enhanced NUE and/or increased biomass production, in the host cell compared to a wild type.

Further, the nucleic acid molecule disclosed herein, in particular the nucleic acid molecule shown column 5 or 7 of table I A or B, application no. 1, may be sufficiently homologous to the sequences of related species such that these nucleic acid molecules may serve as markers for the construction of a genomic map in related organism or for association mapping. Furthermore natural variation in the genomic regions corresponding to nucleic acids disclosed herein, in particular the nucleic acid molecule shown column 5 or 7 of table I A or B, application no. 1, or homologous thereof may lead to variation in the activity of the proteins disclosed herein, in particular the proteins comprising polypeptides as shown in column 5 or 7 of table II A or B, application no. 1, or comprising the consensus sequence or the polypeptide motif as shown in column 7 of table IV, application no. 1, and their homolgous and in consequence in a natural variation of increased nutrient use efficiency and optionally enhanced tolerance to abiotic stress and/or and/or increased yield, in the absence of stress as well as in the absence of nutrient deficiency, especially of NUE and/or biomass production.

In consequence natural variation eventually also exists in form of more active allelic variants leading already to a relative increase in the tolerance to abiotic environmental stress and/or nutrient use efficiency, especially enhancement of NUE and/or biomass production, and/or yield. Different variants of the nucleic acids molecule disclosed herein, in particular the nucleic acid comprising the nucleic acid molecule as shown column 5 or 7 of table I A or B, application no. 1, which corresponds to different enhancement of yield levels, particularly due to one or more improved yield related traits as defined above, especially NUE and/or biomass production levels, can be indentified and used for marker assisted breeding for enhanced yield, especially NUE and/or increased biomass production.

Accordingly, the present invention relates to a method for breeding plants with enhanced yield, especially enhanced nutrient use efficiency, in particular NUE and/or increased biomass production, and optionally enhanced abiotic stress tolerance and/or increased yield, in the absence of stress as well as nutrient deficiencies, comprising (a) selecting a first plant variety with enhanced yield, especially enhanced nutrient use efficiency, in particular NUE and/or increased biomass production, and optionally enhanced abiotic stress tolerance and/or increased yield, in the absence of stress as well as nutrient deficiencies, based on increased expression of a nucleic acid of the invention as disclosed herein, in particular of a nucleic acid molecule comprising a nucleic acid molecule as shown in column 5 or 7 of table I A or B, application no. 1, or a polypeptide comprising a polypeptide as shown in column 5 or 7 of table II A or B, application no. 1, or comprising a consensus sequence or a polypeptide motif as shown in column 7 of table IV, application no. 1, or a homologue thereof as described herein;

(b) associating the level of enhancement of yield, especially of the nutrient use efficiency, in particular the NUE and/or biomass production, and optionally enhanced abiotic stress tolerance and/or increased yield, in the absence of stress as well as nutrient deficiencies, with the expression level or the genomic structure of a gene encoding said polypeptide or said nucleic acid molecule;

(c) crossing the first plant variety with a second plant variety, which significantly differs in its level of enhancement of yield, especially enhanced nutrient use efficiency, in particular NUE and/or biomass production; and (d) identifying, which of the offspring varieties has got increased levels of enhanced NUE and/or biomass production by the expression level of said polypeptide or nucleic acid molecule or the genomic structure of the genes encoding said polypeptide or nucleic acid molecule of the invention.

In one embodiment, the expression level of the gene according to step (b) is increased.

Yet another embodiment of the invention relates to a process for the identification of a compound conferring enhanced yield, especially enhanced nutrient use efficiency, in particular enhanced NUE and/or increased biomass production, and optionally enhanced abiotic stress tolerance and/or increased yield, in the absence of stress as well as nutrient deficiencies, as compared to a corresponding non-transformed wild type plant cell, a plant or a part thereof in a plant cell, a plant or a part thereof, a plant or a part thereof, comprising the steps:

(a) culturing a plant cell; a plant or a part thereof maintaining a plant expressing the polypeptide as shown in column 5 or 7 of table II, application no. 1, or being encoded by a nucleic acid molecule comprising a polynucleotide as shown in column 5 or 7 of table I, application no. 1, or a homologue thereof as described herein or a polynucleotide encoding said polypeptide and conferring enhanced yield, especially enhanced nutrient use efficiency, in particular an enhanced NUE and/or increased biomass production, and optionally enhanced abiotic stress tolerance and/or increased yield, in the absence of stress as well as nutrient deficiencies, as compared to a corresponding non-transformed wild type plant cell, a plant or a part thereof; a non-transformed wild type plant or a part thereof and providing a readout system capable of interacting with the polypeptide under suitable conditions which permit the interaction of the polypeptide with this readout system in the presence of a chemical compound or a sample comprising a plurality of chemical compounds and capable of providing a detectable signal in response to the binding of a chemical compound to said polypeptide under conditions which permit the expression of said readout system and of the protein as shown in column 5 or 7 of table II, application no. 1, or being encoded by a nucleic acid molecule comprising a polynucleotide as shown in column 5 or 7 of table I application no. 1, or a homolog thereof as described herein; and (b) identifying if the chemical compound is an effective agonist by detecting the presence or absence or decrease or increase of a signal produced by said readout system.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing the polypeptide of the present invention. The reaction mixture may be a cell free extract or may comprise a cell or tissue culture. Suitable set ups for the process for identification of a compound of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the process, then it is either possible to isolate the compound from the original sample identified as containing the compound capable of activating or enhancing enhanced yield, especially enhanced nutrient use efficiency, in particular the NUE and/or increased biomass production, and optionally enhanced abiotic stress tolerance and/or increased yield, in the absence of stress as well as nutrient deficiencies, as compared to a corresponding non-transformed wild type, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the said process only comprises a limited number of or only one substance(s). Preferably said sample comprises substances of similar chemical and/or physical properties, and most preferably said substances are identical. Preferably, the compound identified according to the described method above or its derivative is further formulated in a form suitable for the application in plant breeding or plant cell and tissue culture.

The compounds which can be tested and identified according to said process may be expression libraries, e.g., cDNA expression libraries, peptides, proteins, nucleic acids, antibodies, small organic compounds, hormones, peptidomimetics, PNAs or the like (Milner, Nature Medicine 1, 879 (1995); Hupp, Cell 83, 237 (1995); Gibbs, Cell 79, 193 (1994), and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer, N.Y. Inc., 175 Fifth Avenue, New York, N.Y. 10010 U.S.A. and Organic Synthesis, Wiley, New York, USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the process preferably is a host cell, plant cell or plant tissue of the invention described in the embodiments hereinbefore.

Thus, in a further embodiment the invention relates to a compound obtained or identified according to the method for identifying an agonist of the invention said compound being an antagonist of the polypeptide of the present invention.

Accordingly, in one embodiment, the present invention further relates to a compound identified by the method for identifying a compound of the present invention.

In one embodiment, the invention relates to an antibody specifically recognizing the compound or agonist of the present invention.

The invention also relates to a diagnostic composition comprising at least one of the aforementioned nucleic acid molecules, antisense nucleic acid molecule, RNAi, snRNA, dsRNA, siRNA, miRNA, ta-siRNA, cosuppression molecule, ribozyme, vectors, proteins, antibodies or compounds of the invention and optionally suitable means for detection.

The diagnostic composition of the present invention is suitable for the isolation of mRNA from a cell and contacting the mRNA so obtained with a probe comprising a nucleic acid probe as described above under hybridizing conditions, detecting the presence of mRNA hybridized to the probe, and thereby detecting the expression of the protein in the cell. Further methods of detecting the presence of a protein according to the present invention comprise immunotechniques well known in the art, for example enzyme linked immunoadsorbent assay. Furthermore, it is possible to use the nucleic acid molecules according to the invention as molecular markers or primers in plant breeding. Suitable means for detection are well known to a person skilled in the art, e.g. buffers and solutions for hydridization assays, e.g. the aforementioned solutions and buffers, further and means for Southern-, Western-, Northern-etc. -blots, as e.g. described in Sambrook et al. are known. In one embodiment diagnostic composition contain PCR primers designed to specifically detect the presence or the expression level of the nucleic acid molecule to be reduced in the process of the invention, e.g. of the nucleic acid molecule of the invention, or to discriminate between different variants or alleles of the nucleic acid molecule of the invention or which activity is to be reduced in the process of the invention.

In another embodiment, the present invention relates to a kit comprising the nucleic acid molecule, the vector, the host cell, the polypeptide, or the antisense, RNAi, snRNA, dsRNA, siRNA, miRNA, ta-siRNA, cosuppression molecule, or ribozyme molecule, or the viral nucleic acid molecule, the antibody, plant cell, the plant or plant tissue, the harvestable part, the propagation material and/or the compound and/or agonist identified according to the method of the invention.

The compounds of the kit of the present invention may be packaged in containers such as vials, optionally with/in buffers and/or solution. If appropriate, one or more of said components might be packaged in one and the same container. Additionally or alternatively, one or more of said components might be adsorbed to a solid support as, e.g. a nitrocellulose filter, a glas plate, a chip, or a nylon membrane or to the well of a micro titerplate. The kit can be used for any of the herein described methods and embodiments, e.g. for the production of the host cells, transgenic plants, pharmaceutical compositions, detection of homologous sequences, identification of antagonists or agonists, as food or feed or as a supplement thereof or as supplement for the treating of plants, etc.

Further, the kit can comprise instructions for the use of the kit for any of said embodiments.

In one embodiment said kit comprises further a nucleic acid molecule encoding one or more of the aforementioned protein, and/or an antibody, a vector, a host cell, an antisense nucleic acid, a plant cell or plant tissue or a plant. In another embodiment said kit comprises PCR primers to detect and discriminate the nucleic acid molecule to be reduced in the process of the invention, e.g. of the nucleic acid molecule of the invention.

In a further embodiment, the present invention relates to a method for the production of an agricultural composition providing the nucleic acid molecule for the use according to the process of the invention, the nucleic acid molecule of the invention, the vector of the invention, the antisense, RNAi, snRNA, dsRNA, siRNA, miRNA, ta-siRNA, cosuppression molecule, ribozyme, or antibody of the invention, the viral nucleic acid molecule of the invention, or the polypeptide of the invention or comprising the steps of the method according to the invention for the identification of said compound or agonist; and formulating the nucleic acid molecule, the vector or the polypeptide of the invention or the agonist, or compound identified according to the methods or processes of the present invention or with use of the subject matters of the present invention in a form applicable as plant agricultural composition.

In another embodiment, the present invention relates to a method for the production of the plant culture composition comprising the steps of the method of the present invention; and formulating the compound identified in a form acceptable as agricultural composition.

Under "acceptable as agricultural composition" is understood, that such a composition is in agreement with the laws regulating the content of fungicides, plant nutrients, herbicides, etc. Preferably such a composition is without any harm for the protected plants and the animals (humans included) fed therewith.

Throughout this application, various publications are referenced. The disclosures of all of these publications and those references cited within those publications in their entireties are hereby incorporated by reference into this application in order to more fully describe the state of the art to which this invention pertains.

It should also be understood that the foregoing relates to preferred embodiments of the present invention and that numerous changes and variations may be made therein without departing from the scope of the invention. The invention is further illustrated by the following examples, which are not to be construed in any way as limiting. On the contrary, it is to be clearly understood that various other embodiments, modifications and equivalents thereof, which, after reading the description herein, may suggest themselves to those skilled in the art without departing from the spirit of the present invention and/or the scope of the claims.

EXAMPLE 1

Engineering *Arabidopsis* plants expressing genes of the present invention, especially with enhanced NUE and/or increased biomass production by over-expressing NUE related protein genes.

Cloning of the inventive sequences as shown in table I, column 5 and 7, application no. 1, for the expression in plants.

Unless otherwise specified, standard methods as described in Sambrook et al., Molecular Cloning: A laboratory manual, Cold Spring Harbor 1989, Cold Spring Harbor Laboratory Press are used.

The inventive sequences as shown in table I, column 5 and 7, application no. 1, were amplified by PCR as described in the protocol of the Pfu Turbo or Herculase DNA polymerase (Stratagene).

Sequences as shown in table I, column 5, marked with asterisk * reflect the respective sequence derived from public data base information.

The composition for the protocol of the Pfu Turbo or Herculase DNA polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen), *Escherichia coli* (strain MG1655; *E. coli* Genetic Stock Center), 50 pmol forward primer, 50 pmol reverse primer, 2.5 u Pfu Turbo or Herculase DNA polymerase.

The amplification cycles were as follows:
1 cycle of 3 minutes at 94-95° C., followed by 25-36 cycles of in each case 1 minute at 95° C. or 30 seconds at 94° C., 45 seconds at 50° C., 30 seconds at 50° C. or 30 seconds at 55° C. and 210-480 seconds at 72° C., followed by 1 cycle of 8 minutes at 72° C., then 4° C.—preferably for *Saccharomyces cerevisiae*; or
1 cycle of 2-3 minutes at 94° C., followed by 25-30 cycles of in each case 30 seconds at 94° C., 30 seconds at 55-60° C. and 5-10 minutes at 72° C., followed by 1 cycle of 10 minutes at 72° C., then 4° C.—preferably for *Escherichia coli*.

RNA were generated with the RNeasy Plant Kit according to the standard protocol (Qiagen) and Supersript II Reverse Transkriptase was used to produce double stranded cDNA according to the standard protocol (Invitrogen).

The following adapter sequences were added to *Saccharomyces cerevisiae* ORF specific primers (see table III) for cloning purposes:

```
                                            SEQ ID NO 7
i) foward primer:   5'-GGAATTCCAGCTGACCACC-3'

SEQ ID NO 8
ii) reverse primer: 5'-GATCCCCGGGAATTGCCATG-3'
```

The following adapter sequences were added to *Escherichia coli* or *Synechocystis* sp. ORF specific primers for cloning purposes:

```
                                            SEQ ID NO 9
iii) forward primer:    5'-TTGCTCTTCC-3'

SEQ ID NO 10
iiii) reverse primer:   5'-TTGCTCTTCG-3'
```

Therefore for amplification and cloning of *Saccharomyces cerevisiae* SEQ ID NO: 3868, a primer consisting of the adaptor sequence i) and the ORF specific sequence SEQ ID NO: 3878 and a second primer consisting of the adaptor sequence ii) and the ORF specific sequence SEQ ID NO: 3879 were used.

For amplification and cloning of *Echerischia coli* SEQ ID NO: 38, a primer consisting of the adaptor sequence iii) and the ORF specific sequence SEQ ID NO: 40 and a second primer consisting of the adaptor sequence iiii) and the ORF specific sequence SEQ ID NO: 41 were used.

Following these examples every sequence disclosed in table I, preferably column 5, can be cloned by fusing the adaptor sequences to the respective specific primers sequences as disclosed in table III, column 7.

Construction of binary vectors for non-targeted and plastid targeted expression of proteins.

For non-targeted expression the binary vectors used for cloning were VC-MME220-1 SEQ ID NO 1 (FIG. 1a) and VC-MME220-1qcz SEQ ID NO 14389 (FIG. 1b) VCMME221-1 SEQ ID NO 2 (FIG. 2a) and VC-MME221-1qcz SEQ ID NO 14390 (FIG. 2b), and VC-MME489-1p SEQ ID NO 15 (FIG. 5a) and VC-MME489-1QCZ SEQ ID NO: 14395 (FIG. 5b), respectively. The binary vectors used for cloning the targeting sequence were VC-MME489-1p SEQ ID NO 15 (FIG. 5a) and VC-MME489-1QCZ SEQ ID NO: 14395 (FIG. 5b), and pMTX0270p SEQ ID NO 16 (FIG. 6), respectively. Other useful binary vectors are known to the skilled worker; an overview of binary vectors and their use can be found in Hellens R., Mullineaux P. and Klee H., (Trends in Plant Science, 5 (10), 446 (2000)). Such vectors have to be equally equipped with appropriate promoters and targeting sequences.

Amplification of the targeting sequence of the gene FNR from *Spinacia oleracea*

In order to amplify the targeting sequence of the FNR gene from *S. oleracea*, genomic DNA was extracted from leaves of 4 weeks old *S. oleracea* plants (DNeasy Plant Mini Kit, Qiagen, Hilden). The gDNA was used as the template for a PCR.

To enable cloning of the transit sequence into the vector VC-MME0489-1p an EcoRI restriction enzyme recognition sequence was added to both the forward and reverse primers, whereas for cloning in the vectors pMTX0270p a PmeI restriction enzyme recognition sequence was added to the forward primer and a NcoI site was added to the reverse primer.

```
                                            SEQ ID NO 11
FNR5EcoResgen   ATA GAA TTC GCA TAA ACT TAT CTT CAT
                AGT TGC C SEQ ID NO 12
FNR3EcoResgen   ATA GAA TTC AGA GGC GAT CTG GGC CCT SEQ ID NO 13
FNR5PmeColic    ATA GTT TAA ACG CAT AAA CTT ATC TTC
                ATA GTT GCC SEQ ID NO 14
FNR3NcoColic    ATA CCA TGG AAG AGC AAG AGG CGA TCT
                GGG CCC T
```

The resulting sequence SEQ ID NO: 36 amplified from genomic spinach DNA, comprised a 5"UTR (bp 1-165), and the coding region (bp 166-273 and 351-419). The coding sequence is interrupted by an intronic sequence from by 274 to by 350:

```
                                           (SEQ ID NO 36)
gcataaacttatcttcatagttgccactccaatttgctccttgaatc tcctccacccaatacataatccactcctccatcacccacttcactac taaatcaaacttaactctgtttttctctctcctcctttcatttctta ttcttccaatcatcgtactccgccatgaccaccgctgtcaccgccgc tgtttctttcccctctaccaaaaccacctctctctccgcccgaagct cctccgtcatttcccctgacaaaatcagctacaaaaaggtgattccc aatttcactgtgttttttattaataatttgttattttgatgatgaga tgattaatttgggtgctgcaggttcctttgtactacaggaatgtatc tgcaactgggaaaatgggacccatcagggcccagatcgcctct
```

The PCR fragment derived with the primers FNR5EcoResgen and FNR3EcoResgen was digested with EcoRI and ligated in the vector VC-MME0489-1p that had also been digested with EcoRI. The correct orientation of the FNR targeting sequence was tested by sequencing. The vectors generated in this ligation step were VC-MME354-1 SEQ ID NO 3 and VC-MME354-1QCZ SEQ ID NO 14391.

The PCR fragment derived with the primers FNR5PmeColi and FNR3NcoColi was digested with SmaI and NcoI and ligated in the vector pMTX0270p SEQ ID NO 16 (FIG. 6) that had also been digested with PmeI and NcoI. The vectors generated in this ligation step were VC-MME432-1 SEQ ID NO 5 (FIG. 4a) and VC-MME432-1qcz SEQ ID NO 14393 (FIG. 4b), respectively.

For cloning the ORF from S. cerevisiae, like the ORF of SEQ ID NO: 3868, the vector DNA was treated with the restriction enzyme NcoI. For cloning of ORFs from E. coli the vector DNA was treated with the restriction enzymes PacI and NcoI following the standard protocol (MBI Fermentas). The reaction was stopped by inactivation at 70° C. for 20 minutes and purified over QIAquick columns following the standard protocol (Qiagen).

Then the PCR-product representing the amplified ORF and the vector DNA were treated with T4 DNA polymerase according to the standard protocol (MBI Fermentas) to produce single stranded overhangs with the parameters 1 unit T4 DNA polymerase at 37° C. for 2-10 minutes for the vector and 1 u T4 DNA polymerase at 15° C. for 10-60 minutes for the PCR product representing, like that of SEQ ID NO: 3868.

The reaction was stopped by addition of high-salt buffer and purified over QIAquick columns following the standard protocol (Qiagen).

According to this example the skilled person is able to clone all sequences disclosed in table I, preferably column 5.

Approximately 30 ng of prepared vector and a defined amount of prepared amplificate were mixed and hybridized at 65° C. for 15 minutes followed by 37° C. 0.1° C./1 seconds, followed by 37° C. 10 minutes, followed by 0.1° C./1 seconds, then 4° C.

The ligated constructs were transformed in the same reaction vessel by addition of competent E. coli cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with 0.05 mg/ml kanamycine and incubated overnight at 37° C.

The outcome of the cloning step was verified by amplification with the aid of primers which bind upstream and downstream of the integration site, thus allowing the amplification of the insertion. The amplifications were carried as described in the protocol of Taq DNA polymerase (Gibco-BRL).

The amplification cycles were as follows:
1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) supplemented with kanamycin and incubated overnight at 37° C.

The plasmid preparation was carried out as specified in the Qiaprep standard protocol (Qiagen).

Generation of transgenic plants which express SEQ ID NO: 3868 or any other sequence disclosed in table I, preferably column 5

1-5 ng of the plasmid DNA isolated was transformed by electroporation into competent cells of Agrobacterium tumefaciens, of strain GV 3101 pMP90 (Koncz and Schell, Mol. Gen. Gent. 204, 383 (1986)). Thereafter, complete medium (YEP) was added and the mixture was transferred into a fresh reaction vessel for 3 hours at 28° C. Thereafter, all of the reaction mixture was plated onto YEP agar plates supplemented with the respective antibiotics, e.g. rifampicine (0.1 mg/ml), gentamycine (0.025 mg/ml and kanamycine (0.05 mg/ml) and incubated for 48 hours at 28° C.

The agrobacteria that contains the plasmid construct were then used for the transformation of plants.

A colony was picked from the agar plate with the aid of a pipette tip and taken up in 3 ml of liquid TB medium, which also contained suitable antibiotics as described above. The preculture was grown for 48 hours at 28° C. and 120 rpm. 400 ml of LB medium containing the same antibiotics as above were used for the main culture. The preculture was transferred into the main culture. It was grown for 18 hours at 28° C. and 120 rpm. After centrifugation at 4 000 rpm, the pellet was resuspended in infiltration medium (MS medium, 10% sucrose).

In order to grow the plants for the transformation, dishes (Piki Saat 80, green, provided with a screen bottom, 30×20× 4.5 cm, from Wiesauplast, Kunststofftechnik, Germany) were half-filled with a GS 90 substrate (standard soil, Werkverband E. V., Germany). The dishes were watered overnight with 0.05% Proplant solution (Chimac-Apriphar, Belgium). Arabidopsis thaliana C24 seeds (Nottingham Arabidopsis Stock Centre, UK; NASC Stock N906) were scattered over the dish, approximately 1 000 seeds per dish. The dishes were covered with a hood and placed in the stratification facility (8 h, 110 µmol/m$^2$s, 22° C.; 16 h, dark, 6° C.). After 5 days, the dishes were placed into the short-day controlled environment chamber (8 h, 130 µmol/m$^2$s, 22° C.; 16 h, dark, 20° C.), where they remained for approximately 10 days until the first true leaves had formed.

The seedlings were transferred into pots containing the same substrate (Teku pots, 7 cm, LC series, manufactured by Poppelmann GmBH & Co, Germany). Five plants were pricked out into each pot. The pots were then returned into the short-day controlled environment chamber for the plant to continue growing.

After 10 days, the plants were transferred into the greenhouse cabinet (supplementary illumination, 16 h, 340 µE/m$^2$s, 22° C.; 8 h, dark, 20° C.), where they were allowed to grow for further 17 days.

For the transformation, 6-week-old Arabidopsis plants, which had just started flowering were immersed for 10 seconds into the above-described agrobacterial suspension which had previously been treated with 10 µl Silwett L77 (Crompton S. A., Osi Specialties, Switzerland). The method in question is described by Clough J. C. and Bent A. F. (Plant J. 16, 735 (1998)).

The plants were subsequently placed for 18 hours into a humid chamber. Thereafter, the pots were returned to the greenhouse for the plants to continue growing. The plants remained in the greenhouse for another 10 weeks until the seeds were ready for harvesting.

Depending on the resistance marker used for the selection of the transformed plants the harvested seeds were planted in the greenhouse and subjected to a spray selection or else first sterilized and then grown on agar plates supplemented with the respective selection agent. Since the vector contained the bar gene as the resistance marker, plantlets were sprayed four times at an interval of 2 to 3 days with 0.02% BASTA® and transformed plants were allowed to set seeds.

The seeds of the transgenic A. thaliana plants were stored in the freezer (at −20° C.).

Plant Screening (Arabidopsis) for growth under low temperature conditions or growth under limited nitrogen supply or growth under conditions in the absence of stress as well as nutrient deficiencies Plant screening (*Arabidopsis*) for growth under limited nitrogen supply For screening of transgenic plants a specific culture facility was used. For high-throughput purposes plants were screened for biomass production on agar plates with limited supply of nitrogen (adapted from Estelle and Somerville, 1987). This screening pipeline consists of two levels. Transgenic lines are subjected to subsequent level if biomass production was significantly improved in comparison to wild type plants. With each level number of replicates and statistical stringency was increased.

For the sowing, the seeds, which had been stored in the refrigerator (at −20° C.), were removed from the Eppendorf tubes with the aid of a toothpick and transferred onto the above-mentioned agar plates, with limited supply of nitrogen (0.05 mM $KNO_3$). In total, approximately 15-30 seeds were distributed horizontally on each plate (12×12 cm).

After the seeds had been sown, plates are subjected to stratification for 2-4 days in the dark at 4° C. After the stratification, the test plants were grown for 22 to 25 days at a 16-h-light, 8-h-dark rhythm at 20° C., an atmospheric humidity of 60% and a $CO_2$ concentration of approximately 400 ppm. The light sources used generate a light resembling the solar color spectrum with a light intensity of approximately 100 μE/m²s. After 10 to 11 days the plants are individualized. Improved growth under nitrogen limited conditions was assessed by biomass production of shoots and roots of transgenic plants in comparison to wild type control plants after 20-25 days growth.

Transgenic lines showing a significant improved biomass production in comparison to wild type plants are subjected to following experiment of the subsequent level:

*Arabidopsis thaliana* seeds are sown in pots containing a 1:1 (v:v) mixture of nutrient depleted soil ("Einheitserde Typ 0", 30% clay, Tantau, Wansdorf Germany) and sand. Germination is induced by a four day period at 4° C., in the dark. Subsequently the plants are grown under standard growth conditions (photoperiod of 16 h light and 8 h dark, 20° C., 60% relative humidity, and a photon flux density of 200 μE/m²s). The plants are grown and cultured, inter alia they are watered every second day with a N-depleted nutrient solution. The N-depleted nutrient solution e.g. contains beneath water

| mineral nutrient | final concentration |
| --- | --- |
| KCl | 3.00 mM |
| $MgSO_4 \times 7 H_2O$ | 0.5 mM |
| $CaCl_2 \times 6 H_2O$ | 1.5 mM |
| $K_2SO_4$ | 1.5 mM |
| $NaH_2PO_4$ | 1.5 mM |
| Fe-EDTA | 40 μM |
| $H_3BO_3$ | 25 μM |
| $MnSO_4 \times H_2O$ | 1 μM |
| $ZnSO_4 \times 7 H_2O$ | 0.5 μM |
| $Cu_2SO_4 \times 5 H_2O$ | 0.3 μM |
| $Na_2MoO_4 \times 2 H_2O$ | 0.05 μM |

After 9 to 10 days the plants are individualized. After a total time of 29 to 31 days the plants are harvested and rated by the fresh weight of the aerial parts of the plants. The results thereof are summarized in table VII-A. The biomass increase has been measured as ratio of the fresh weight of the aerial parts of the respective transgene plant and the non-transgenic wild type plant.

TABLE VII-A

| SeqID | Target | Locus | Biomass Increase |
| --- | --- | --- | --- |
| 38 | Cytoplasmic | B0017 | 1.19 |
| 42 | Cytoplasmic | B0045 | 1.15 |
| 123 | Plastidic | B0180 | 1.41 |
| 380 | Plastidic | B0242 | 1.16 |
| 679 | Plastidic | B0403 | 1.10 |
| 812 | Cytoplasmic | B0474 | 1.24 |
| 1055 | Plastidic | B0754 | 1.15 |
| 1563 | Cytoplasmic | B0784 | 1.20 |
| 1705 | Plastidic | B0873 | 1.17 |
| 1844 | Cytoplasmic | B1014 | 1.19 |
| 1950 | Plastidic | B1020 | 1.10 |
| 1975 | Cytoplasmic | B1180 | 1.23 |
| 2127 | Plastidic | B1933 | 1.55 |
| 2135 | Plastidic | B2032 | 1.24 |
| 2171 | Plastidic | B2165 | 1.24 |
| 2297 | Plastidic | B2223 | 1.36 |
| 2426 | Plastidic | B2238 | 1.26 |
| 2452 | Plastidic | B2310 | 1.18 |
| 2551 | Plastidic | B2431 | 1.47 |
| 2600 | Plastidic | B2600 | 1.12 |
| 2668 | Plastidic | B2766 | 1.10 |
| 2772 | Cytoplasmic | B2903 | 1.65 |
| 3117 | Plastidic | B3117 | 1.42 |
| 3390 | Plastidic | B3120 | 1.28 |
| 3396 | Plastidic | B3216 | 1.19 |
| 3470 | Plastidic | B3451 | 1.21 |
| 3563 | Cytoplasmic | B3791 | 1.25 |
| 3770* | Plastidic | B3825 | 1.42 |
| 3868 | Cytoplasmic | Yal019w | 1.42 |
| 3895 | Cytoplasmic | Yar035w | 1.38 |
| 3953 | Cytoplasmic | Ybl021c | 1.15 |
| 4111 | Cytoplasmic | Ybr055c | 1.10 |
| 4149 | Cytoplasmic | YBR128C | 1.19 |
| 4162 | Cytoplasmic | Ybr159w | 1.23 |
| 4235 | Cytoplasmic | Ybr243c | 1.16 |
| 4280 | Cytoplasmic | Ybr262c | 1.31 |
| 4288 | Cytoplasmic | Ycr019w | 1.31 |
| 4315 | Cytoplasmic | Ydr070c | 1.20 |
| 4325 | Cytoplasmic | Ydr079w | 1.29 |
| 4335 | Cytoplasmic | Ydr123c | 1.19 |
| 4346 | Cytoplasmic | Ydr137w | 1.22 |
| 4361 | Cytoplasmic | Ydr294c | 1.13 |
| 4402 | Cytoplasmic | Ydr330w | 1.38 |
| 4431 | Cytoplasmic | Ydr355c | 1.34 |
| 4435 | Plastidic | YDR430C | 1.16 |
| 4485 | Cytoplasmic | Ydr472w | 1.20 |
| 4506 | Plastidic | YDR497C | 1.16 |
| 4790 | Cytoplasmic | Yer029c | 1.23 |
| 4806 | Cytoplasmic | YFR007W | 1.36 |
| 4836 | Cytoplasmic | YGL039W | 1.22 |
| 5311 | Cytoplasmic | Ygl043w | 1.26 |
| 5346 | Cytoplasmic | Ygr088w | 1.13 |
| 5533 | Cytoplasmic | Ygr122c-a | 1.30 |
| 5551 | Cytoplasmic | Ygr142w | 1.21 |
| 5559 | Cytoplasmic | Ygr143w | 1.19 |
| 5602 | Cytoplasmic | Ygr165w | 1.23 |
| 5608 | Cytoplasmic | Ygr170w | 1.12 |
| 5614 | Cytoplasmic | Ygr202c | 1.55 |
| 5666 | Cytoplasmic | Ygr266w | 1.34 |
| 5701 | Cytoplasmic | Ygr282c | 1.21 |
| 5750 | Cytoplasmic | Ygr290w | 1.19 |
| 5754 | Cytoplasmic | Yhl021c | 1.19 |
| 5778 | Cytoplasmic | Yhl031c | 1.21 |
| 5812 | Cytoplasmic | Yhr011w | 1.21 |
| 5967 | Cytoplasmic | Yhr127w | 1.36 |
| 5973 | Cytoplasmic | Yhr137w | 1.39 |
| 6027 | Cytoplasmic | Yil099w | 3.09 |
| 6107 | Cytoplasmic | Yil147c | 1.21 |
| 6150* | Cytoplasmic | Yir034c | 2.42 |
| 6198 | Cytoplasmic | Yjl013c | 1.42 |
| 6208 | Cytoplasmic | Yjl041w | 1.41 |
| 6242 | Cytoplasmic | Yjl064w | 1.30 |
| 6246 | Cytoplasmic | Yjl067w | 1.29 |
| 6250 | Cytoplasmic | Yjl094c | 1.23 |
| 6297 | Cytoplasmic | Yjl171c | 1.19 |
| 6326 | Cytoplasmic | Yjl213w | 1.62 |
| 6488 | Cytoplasmic | Yjr017c | 1.50 |
| 6550 | Cytoplasmic | Yjr058c | 1.28 |

TABLE VII-A-continued

| SeqID | Target | Locus | Biomass Increase |
|---|---|---|---|
| 6700 | Cytoplasmic | Yjr117w | 1.81 |
| 6816 | Cytoplasmic | Yjr121w | 1.52 |
| 7366* | Cytoplasmic | Yjr131w | 1.52 |
| 7475 | Cytoplasmic | Yjr145c | 1.41 |
| 7602 | Cytoplasmic | Ykl084w | 1.20 |
| 7651 | Cytoplasmic | Ykl088w | 1.23 |
| 7661* | Cytoplasmic | Ykl100c | 1.25 |
| 7675 | Cytoplasmic | Ykl131w | 1.22 |
| 7679 | Cytoplasmic | Ykl138c | 1.24 |
| 7710 | Cytoplasmic | Ykl178c | 2.69 |
| 7735 | Cytoplasmic | Ykl179c | 1.58 |
| 7778* | Cytoplasmic | Ykl193c | 1.77 |
| 7829 | Cytoplasmic | Ykl216w | 2.09 |
| 8017 | Cytoplasmic | Ykr016w | 2.00 |
| 8045 | Cytoplasmic | Ykr021w | 2.14 |
| 8073 | Cytoplasmic | Ykr055w | 1.57 |
| 8263 | Plastidic | Ykr088c | 1.29 |
| 8287 | Cytoplasmic | Ykr093w | 3.98 |
| 8468 | Cytoplasmic | Ykr099w | 1.15 |
| 8484* | Cytoplasmic | Ykr100c | 4.43 |
| 8492 | Cytoplasmic | Yll014w | 1.61 |
| 8514* | Cytoplasmic | Yll016w | 1.24 |
| 8539 | Cytoplasmic | Yll023c | 1.17 |
| 8571 | Cytoplasmic | Yll037w | 1.32 |
| 8575 | Cytoplasmic | Yll049w | 1.75 |
| 8579 | Cytoplasmic | Yll055w | 5.25 |
| 8661* | Cytoplasmic | Ylr034c | 4.38 |
| 8991 | Cytoplasmic | Ylr042c | 1.40 |
| 8995 | Cytoplasmic | Ylr053c | 1.55 |
| 8999 | Cytoplasmic | Ylr058c | 1.19 |
| 9551* | Cytoplasmic | Ylr060w | 3.72 |
| 9637 | Cytoplasmic | Ylr065c | 1.88 |
| 9672 | Cytoplasmic | Ylr070c | 2.66 |
| 10182 | Cytoplasmic | Ylr00w | 1.57 |
| 10214 | Cytoplasmic | Ylr109w | 1.55 |
| 10447 | Cytoplasmic | Ylr125w | 1.28 |
| 10451 | Cytoplasmic | Ylr127c | 1.22 |
| 10463 | Cytoplasmic | Ylr185w | 1.14 |
| 10533 | Cytoplasmic | Ylr204w | 1.38 |
| 10541 | Cytoplasmic | Ylr242c | 1.61 |
| 10562 | Cytoplasmic | Ylr293c | 2.75 |
| 10990 | Cytoplasmic | Ylr313c | 1.25 |
| 10998 | Cytoplasmic | Ylr315w | 1.54 |
| 11004 | Cytoplasmic | Ylr329w | 1.27 |
| 11012 | Cytoplasmic | Ylr362w | 3.40 |
| 11054 | Cytoplasmic | Ylr395c | 1.56 |
| 11066 | Cytoplasmic | Ylr404w | 1.33 |
| 11074 | Cytoplasmic | Ylr463c | 1.33 |
| 11080 | Cytoplasmic | Yml022w | 1.27 |
| 11552 | Cytoplasmic | Yml027w | 1.42 |
| 11569 | Cytoplasmic | Yml065w | 1.14 |
| 11596 | Cytoplasmic | Yml089c | 1.17 |
| 11600 | Cytoplasmic | Yml128c | 1.12 |
| 11612 | Cytoplasmic | Ymr011w | 1.52 |
| 12246 | Cytoplasmic | Ymr037c | 1.41 |
| 12263 | Cytoplasmic | Ymr049c | 3.71 |
| 12316 | Cytoplasmic | Ymr052w | 1.28 |
| 12327* | Cytoplasmic | Ymr082c | 1.26 |
| 12331 | Cytoplasmic | YMR125W | 1.24 |
| 12378 | Cytoplasmic | Ymr126c | 1.19 |
| 12394 | Cytoplasmic | Ymr144w | 1.36 |
| 12406 | Cytoplasmic | Ymr160w | 1.29 |
| 12414* | Cytoplasmic | Ymr191w | 1.51 |
| 12420 | Cytoplasmic | Ymr209c | 1.18 |
| 12440 | Cytoplasmic | Ymr233w | 1.61 |
| 12470 | Cytoplasmic | Ymr278w | 1.20 |
| 12749 | Cytoplasmic | Ymr280c | 1.31 |
| 12773 | Cytoplasmic | Ynl014w | 1.21 |
| 12829 | Cytoplasmic | Ynl320w | 1.46 |
| 12883 | Cytoplasmic | Yol007c | 1.15 |
| 12889 | Cytoplasmic | Yol164w | 1.21 |
| 13014 | Cytoplasmic | Yor076c | 1.10 |
| 13018 | Cytoplasmic | Yor083w | 1.48 |
| 13024 | Cytoplasmic | Yor097c | 1.19 |
| 13030 | Cytoplasmic | Yor128c | 1.46 |
| 14085 | Cytoplasmic | Yor353c | 1.26 |
| 14093 | Cytoplasmic | Ypl141c | 1.33 |
| 14113 | Cytoplasmic | Ypr088c | 1.61 |
| 14246 | Cytoplasmic | Ypr108w | 1.25 |
| 14311 | Cytoplasmic | Ypr110c | 1.22 |
| 14914 | Plastidic | B3825__2 | 1.42 |
| 15382 | Cytoplasmic | Yir034c__2 | 2.42 |
| 15460 | Cytoplasmic | Yjr131w__2 | 1.52 |
| 15571 | Cytoplasmic | Ykl100c__2 | 1.25 |
| 15593 | Cytoplasmic | Ykl193c__2 | 1.77 |
| 15646 | Cytoplasmic | Yll016w__2 | 1.24 |
| 15673 | Cytoplasmic | Ylr034c__2 | 4.38 |
| 16005 | Cytoplasmic | Ylr060w__2 | 3.72 |
| 16114 | Cytoplasmic | YMR082C__2 | 1.26 |
| 14402 | Cytoplasmic | B1258 | 1.36 |
| 16093 | Cytoplasmic | YML101C | 1.35 |
| 16106 | Cytoplasmic | YMR065W | 1.28 |
| 16120 | Cytoplasmic | YMR163C | 1.21 |
| 16275 | Cytoplasmic | YOL042W | 1.16 |
| 16305 | Cytoplasmic | YOR226C | 1.24 |
| 16573 | Cytoplasmic | YPL068C | 1.11 |
| 14396 | Plastidic | B0165 | 1.14 |
| 16299 | Cytoplasmic | YOR203W | 1.21 |
| 16133 | Cytoplasmic | YNL147W | 1.15 |
| 15056 | Cytoplasmic | YBR083W | 1.11 |
| 15587 | Cytoplasmic | YKL111C | 1.11 |
| 16582 | Cytoplasmic | YPR067W | 1.13 |
| 14839 | Cytoplasmic | B1985 | 1.16 |
| 15014 | Cytoplasmic | B3838 | 1.42 |
| 15432 | Cytoplasmic | YJL010C | 1.11 |
| 14497 | Cytoplasmic | B1267 | 1.23 |
| 14718 | Cytoplasmic | B1322 | 1.33 |
| 14791 | Cytoplasmic | B1381 | 1.11 |
| 14879 | Cytoplasmic | B2646 | 1.31 |
| 15064 | Cytoplasmic | YBR191W | 1.12 |
| 15257 | Cytoplasmic | YDL135C | 1.33 |
| 15378 | Cytoplasmic | YHL005C | 1.25 |
| 16629 | Cytoplasmic | YKR100C__2 | 4.43 |
| 16647 | Cytoplasmic | Ymr191w__2 | 1.51 |

Sequences marked with asterisk * reflect the respective sequence derived from public data bases information.

Plant screening (*Arabidopsis*) for growth under low temperature conditions

In a standard experiment soil was prepared as 3.5:1 (v:v) mixture of nutrient rich soil (GS90, Tantau, Wansdorf, Germany) and sand. Pots were filled with soil mixture and placed into trays. Water was added to the trays to let the soil mixture take up appropriate amount of water for the sowing procedure. The seeds for transgenic *Arabidopsis thaliana* plants (created as described above) were sown in pots (6 cm diameter). Pots were collected until they filled a tray for the growth chamber. Then the filled tray was covered with a transparent lid and transferred into the shelf system of the precooled (4° C.-5° C.) growth chamber. Stratification was established for a period of 2-3 days in the dark at 4° C.-5° C. Germination of seeds and growth was initiated at a growth condition of 20° C., 60% relative humidity, 16 h photoperiod and illumination with fluorescent light at 200 µmol/m$^2$s. Covers were removed 7 days after sowing. BASTA selection was done at day 9 after sowing by spraying pots with plantlets from the top. Therefore, a 0.07% (v:v) solution of BASTA concentrate (183 g/L glufosinate-ammonium) in tap water was sprayed. Transgenic events and wildtype control plants were distributed randomly over the chamber. The location of the trays inside the chambers was changed on working days from day 7 after sowing. Watering was carried out every two days after covers were removed from the trays. Plants were individualized 12-13 days after sowing by removing the surplus of seedlings leaving one seedling in a pot. Cold (chilling to 11° C.-12° C.) was applied 14 days after sowing until the end of the experiment. For measuring biomass performance, plant fresh weight was determined at harvest time (29-31 days after sowing) by cutting shoots and weighing them. Besides weighing, phenotypic information was added in case of plants that differ from the wild type control. Plants were in the stage prior to flowering and prior to growth of inflorescence when harvested.

Three successive experiments were conducted. In the first experiment, one individual of each transformed line was tested.

In the second experiment, the event that had been determined as chilling tolerant or resistant in the first experiment, i.e. showed increased yield, in this case increased biomass production, in comparison to wild type, were put through a confirmation screen according to the same experimental procedures. In this experiment, max. 10 plants of each tolerant or resistant event were grown, treated and measured as before.

In the first two experiments, chilling tolerance or tolerance and biomass production was compared to wild type plants.

In the third experiment, up to 20 replicates of each confirmed tolerant event, i.e. those that had been scored as tolerant or resistant in the second experiment, were grown, treated and scored as before. The results thereof are summarized in table VII-B.

TABLE VII-B

| SeqID | Target | Locus | Biomass Increase |
| --- | --- | --- | --- |
| 1055 | Plastidic | B0754 | 1.09 |
| 1950 | Plastidic | B1020 | 1.17 |
| 2127 | Plastidic | B1933 | 1.12 |
| 2426 | Plastidic | B2238 | 1.19 |
| 2452 | Plastidic | B2310 | 1.25 |
| 2551 | Plastidic | B2431 | 1.34 |
| 2668 | Plastidic | B2766 | 1.26 |
| 3117 | Plastidic | B3117 | 1.16 |
| 3390 | Plastidic | B3120 | 1.15 |
| 3470 | Plastidic | B3451 | 1.10 |
| 4162 | Cytoplasmic | Ybr159w | 1.07 |
| 4235 | Plastidic | Ybr243c | 1.26 |
| 4288 | Cytoplasmic | Ycr019w | 1.24 |
| 4325 | Cytoplasmic | Ydr079w | 1.09 |
| 4346 | Cytoplasmic | Ydr137w | 1.14 |
| 4402 | Cytoplasmic | Ydr330w | 1.24 |
| 4435 | Plastidic | YDR430C | 1.10 |
| 4506 | Plastidic | YDR497C | 1.23 |
| 4790 | Cytoplasmic | Yer029c | 1.13 |
| 4836 | Cytoplasmic | YGL039W | 1.32 |
| 5754 | Cytoplasmic | Yhl021c | 1.12 |
| 5973 | Plastidic | Yhr137w | 1.13 |
| 6027 | Plastidic | Yil099w | 1.20 |
| 6326 | Cytoplasmic | Yjl213w | 1.12 |
| 7602 | Cytoplasmic | Ykl084w | 1.10 |
| 7735 | Cytoplasmic | Ykl179c | 1.22 |
| 8073 | Cytoplasmic | Ykr055w | 1.09 |
| 8263 | Plastidic | Ykr088c | 1.20 |
| 8484 | Cytoplasmic | Ykr100c | 1.12 |
| 10533 | Plastidic | Ylr204w | 1.22 |
| 12773 | Cytoplasmic | Ynl014w | 1.11 |
| 14113 | Cytoplasmic | Ypr088c | 1.26 |
| 14396 | Plastidic | B0165 | 1.08 |
| 14718 | Cytoplasmic | B1322 | 1.06 |
| 14879 | Cytoplasmic | B2646 | 1.11 |
| 16629 | Cytoplasmic | YKR100C_2 | 1.12 |

Plant screening (*Arabidopsis*) for growth under cycling drought conditions

In the cycling drought assay repetitive stress is applied to plants without leading to desiccation. In a standard experiment soil is prepared as 1:1 (v:v) mixture of nutrient rich soil (GS90, Tantau, Wansdorf, Germany) and quarz sand. Pots (6 cm diameter) were filled with this mixture and placed into trays. Water was added to the trays to let the soil mixture take up appropriate amount of water for the sowing procedure (day 1) and subsequently seeds of transgenic *A. thaliana* plants and their wild-type controls were sown in pots. Then the filled tray was covered with a transparent lid and transferred into a precooled (4° C.-5° C.) and darkened growth chamber. Stratification was established for a period of 3 days in the dark at 4° C.-5° C. or, alternatively, for 4 days in the dark at 4° C. Germination of seeds and growth was initiated at a growth condition of 20° C., 60% relative humidity, 16 h photoperiod and illumination with fluorescent light at approximately 200 µmol/m²s. Covers were removed 7-8 days after sowing. BASTA selection was done at day 10 or day 11 (9 or 10 days after sowing) by spraying pots with plantlets from the top. In the standard experiment, a 0.07% (v/v) solution of BASTA concentrate (183 g/L glufosinate-ammonium) in tap water was sprayed once or, alternatively, a 0.02% (v:v) solution of BASTA was sprayed three times. The wild-type control plants were sprayed with tap water only (instead of spraying with BASTA dissolved in tap water) but were otherwise treated identically. Plants were individualized 13-14 days after sowing by removing the surplus of seedlings and leaving one seedling in soil. Transgenic events and wild-type control plants were evenly distributed over the chamber.

The water supply throughout the experiment was limited and plants were subjected to cycles of drought and re-watering. Watering was carried out at day 1 (before sowing), day 14 or day 15, day 21 or day 22, and, finally, day 27 or day 28. For measuring biomass production, plant fresh weight was determined one day after the final watering (day 28 or day 29) by cutting shoots and weighing them. Besides weighing, phenotypic information was added in case of plants that differ from the wild type control. Plants were in the stage prior to flowering and prior to growth of inflorescence when harvested.

Up to five lines (events) per transgenic construct were tested in successive experimental levels (up to 4). Only constructs that displayed positive performance were subjected to the next experimental level. Usually in the first level five plants per construct were tested and in the subsequent levels 30-60 plants were tested. Biomass performance was evaluated as described above. Data are shown for constructs that displayed increased biomass performance in at least two successive experimental levels in Table VII-C.

Biomass production was measured by weighing plant rosettes. Biomass increase was calculated as ratio of average weight for transgenic plants compared to average weight of wild type control plants from the same experiment. The mean biomass increase of transgenic constructs is given.

TABLE VII-C

| SeqID | Target | Locus | Biomass Increase |
| --- | --- | --- | --- |
| 2426 | Cytoplasmic | B2238 | 1.11 |
| 4361 | Plastidic | Ydr294c | 1.35 |
| 4506 | Plastidic | YDR497C | 1.10 |
| 9637 | Cytoplasmic | Ylr065c | 1.24 |

Plant screening (*Arabidopsis*) for yield increase under standardized conditions In this experiment, a plant screening for yield increase (in this case: biomass yield increase) under standardized growth conditions in the absence of substantial abiotic stress and biotic stress has been performed. In a standard experiment soil is prepared as 3.5:1 (v:v) mixture of nutrient rich soil (GS90, Tantau, Wansdorf, Germany) and quartz sand. Alternatively, plants were sown on nutrient rich soil (GS90, Tantau, Germany). Pots were filled with soil mixture and placed into trays. Water was added to the trays to let the soil mixture take up appropriate amount of water for the sowing procedure. The seeds for transgenic *A. thaliana* plants and their non-transgenic wild-type controls were sown in pots (6 cm diameter). Then the filled tray was covered with a transparent lid and transferred into a precooled (4° C.-5° C.) and darkened growth chamber. Stratification was established for a period of 3-4 days in the dark at 4° C.-5° C. Germination of seeds and growth was initiated at a growth condition of 20° C., 60% relative humidity, 16 h photoperiod and illumination with fluorescent light at approximately 200 µmol/m²s. Covers were removed 7-8 days after sowing. BASTA selection was done at day 10 or day 11 (9 or 10 days after sowing) by spraying pots with plantlets from the top. In the standard experiment, a 0.07% (v:v) solution of BASTA concentrate (183 g/L glufosinate-ammonium) in tap water was sprayed once or, alternatively, a 0.02% (v:v) solution of BASTA was sprayed three times. The wild-type control plants were sprayed with tap water only (instead of spraying with BASTA dissolved in tap water) but were otherwise treated identically. Plants were individualized 13-14 days after sowing by removing the surplus of seedlings and leaving one seedling in soil. Transgenic events and wild-type control plants were evenly distributed over the chamber. Watering was carried out as needed, every two days after removing the covers in a standard experiment or, alternatively, every day. For measuring biomass performance, plant fresh weight was determined at harvest time (24-29 days after sowing) by cutting shoots and weighing them. Plants were in the stage prior to flowering and prior to growth of inflorescence when harvested. Transgenic plants were compared to the non-transgenic wild-type control plants.

Per transgenic construct up to five events, with up to 60 plants per event, were tested in up to four experimental levels. Biomass performance was evaluated as described below; the respective data are summarized in table VII-D.

Biomass production was measured by harvesting and weighing plant rosettes. Biomass increase was calculated as ratio of average weight of transgenic plants compared to average weight of wild-type control plants from the same experiment. The mean biomass increase of transgenic constructs is given.

TABLE VII-D

| SeqID | Target | Locus | Biomass Increase |
|---|---|---|---|
| 123 | Plastidic | B0180 | 1.33 |
| 812 | Cytoplasmic | B0474 | 1.09 |
| 1055 | Plastidic | B0754 | 1.23 |
| 1975 | Cytoplasmic | B1180 | 1.18 |
| 2135 | Plastidic | B2032 | 1.14 |
| 2171 | Plastidic | B2165 | 1.24 |
| 2426 | Plastidic | B2238 | 1.18 |
| 2452 | Plastidic | B2310 | 1.20 |
| 2551 | Plastidic | B2431 | 1.17 |
| 2600 | Plastidic | B2600 | 1.16 |
| 2668 | Plastidic | B2766 | 1.20 |
| 3390 | Plastidic | B3120 | 1.39 |
| 3470 | Plastidic | B3451 | 1.23 |
| 3868 | Cytoplasmic | Yal019w | 1.14 |
| 3895 | Cytoplasmic | Yar035w | 1.43 |
| 4235 | Plastidic | Ybr243c | 1.29 |
| 4315 | Cytoplasmic | Ydr070c | 1.47 |
| 4402 | Cytoplasmic | Ydr330w | 1.14 |
| 4435 | Plastidic | YDR430C | 1.61 |
| 4506 | Plastidic | YDR497C | 1.14 |
| 4790 | Cytoplasmic | Yer029c | 1.10 |
| 6550 | Cytoplasmic | Yjr058c | 1.36 |
| 6700 | Cytoplasmic | Yjr117w | 1.22 |
| 6816 | Cytoplasmic | Yjr121w | 1.37 |
| 7710 | Cytoplasmic | Ykl178c | 1.57 |
| 8468 | Cytoplasmic | Ykr099w | 1.50 |
| 8484 | Cytoplasmic | Ykr100c | 1.30 |
| 8995 | Cytoplasmic | Ylr053c | 1.17 |

TABLE VII-D-continued

| SeqID | Target | Locus | Biomass Increase |
|---|---|---|---|
| 14396 | Plastidic | B0165 | 1.79 |
| 15432 | Cytoplasmic | YJL010C | 1.47 |
| 14718 | Cytoplasmic | B1322 | 1.20 |
| 14879 | Cytoplasmic | B2646 | 1.23 |
| 16629 | Cytoplasmic | YKR100C_2 | 1.30 |

EXAMPLE 2

Engineering *Arabidopsis* plants with increased yield, especially enhanced stress tolerance, preferably tolerance to low temperature and/or tolerance to drought conditions, and/or enhanced nutrient use efficiency, in particular enhanced NUE and/or increased biomass production, and/or increased biomass production by over-expressing NUE (NUERP) related protein encoding genes from *Saccharomyces cereviesae* or *E. coli* using tissue-specific promoters and/or stress inducible promoters.

Transgenic *Arabidopsis* plants are created as in example 1 to express the NUE related protein (NUERP) encoding transgenes under the control of a tissue-specific promoter and/or stress inducible promoters.

T2 generation plants are produced and are grown under the respective conditions (low temperature, drought conditions, N-limited conditions, conditions in the absence of stress as well as nutrient deficiencies. Biomass production is determined after a total time of 29 to 31 days starting with the sowing. The transgenic *Arabidopsis* produces more biomass than non-transgenic control plants.

EXAMPLE 3

Engineering alfalfa plants with increased yield, especially enhanced stress tolerance, preferably tolerance to low temperature and/or tolerance to drought conditions, and/or enhanced nutrient use efficiency, in particular enhanced NUE and/or increased biomass production, by over-expressing NUE related protein (NUERP) encoding genes from *Saccharomyces cerevisiae* or *E. coli* by over-expressing NUE related protein (NUERP) encoding genes for example from *Brassica napus, Glycine max, Zea mays* or *Oryza sativa* for example A regenerating clone of alfalfa (*Medicago sativa*) is transformed using the method of (McKersie et al., Plant Physiol 119, 839 (1999)). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D. C. W. and Atanassov A. (Plant Cell Tissue Organ Culture 4, 111 (1985)). Alternatively, the RA3 variety (University of Wisconsin) is selected for use in tissue culture (Walker et al., Am. J. Bot. 65, 654 (1978)).

Petiole explants are cocultivated with an overnight culture of *Agrobacterium tumefaciens* C58C1 pMP90 (McKersie et al., Plant Physiol 119, 839 (1999)) or LBA4404 containing a binary vector. Many different binary vector systems have been described for plant transformation (e.g. An G., in *Agrobacterium* Protocols, Methods in Molecular Biology, Vol 44, pp 47-62, Gartland K. M. A. and Davey M. R. eds. Humana Press, Totowa, N.J.). Many are based on the vector pBIN19 described by Bevan (Nucleic Acid Research. 12, 8711 (1984)) that includes a plant gene expression cassette flanked by the left and right border sequences from the Ti plasmid of

*Agrobacterium tumefaciens.* A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,7673,666 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) is used to provide constitutive expression of the trait gene.

The explants are cocultivated for 3 days in the dark on SH induction medium containing 288 mg/L Pro, 53 mg/L thioproline, 4.35 g/L $K_2SO_4$, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. T1 or T2 generation plants are produced and are grown under the respective conditions (low temperature, drought conditions, N-limited conditions, conditions in the absence of stress as well as nutrient deficiencies, especially subjected to experiments with limited nitrogen supply: Plants receive limited nitrogen supply by use of a nutrient depleted soil. Nutrients apart from nitrogen are supplied by a nutrient solution. For NUE assessment biomass production and/or dry matter production and/or seed yield is compared to non-transgenic wild type plants. For the other traits the procedure is adapted accordingly.

EXAMPLE 4

Engineering ryegrass plants with increased yield, especially enhanced stress tolerance, preferably tolerance to low temperature and/or tolerance to drought conditions, and/or enhanced nutrient use efficiency, in particular enhanced NUE, by over-expressing NUE related protein (NUERP) encoding genes from *Saccharomyces cerevisiae* or *E. coli* or by over-expressing NUE related protein (NUERP) encoding genes from for example *Brassica napus, Glycine max, Zea mays* or *Oryza sativa.*

Seeds of several different ryegrass varieties may be used as explant sources for transformation, including the commercial variety Gunne available from Svalof Weibull seed company or the variety Affinity. Seeds are surface-sterilized sequentially with 1% Tween-20 for 1 minute, 100% bleach for 60 minutes, 3 rinses with 5 minutes each with deionized and distilled $H_2O$, and then germinated for 3-4 days on moist, sterile filter paper in the dark. Seedlings are further sterilized for 1 minute with 1% Tween-20, 5 minutes with 75% bleach, and rinsed 3 times with double distilled $H_2O$, 5 min each.

Surface-sterilized seeds are placed on the callus induction medium containing Murashige and Skoog basal salts and vitamins, 20 g/L sucrose, 150 mg/L asparagine, 500 mg/L casein hydrolysate, 3 g/L Phytagel, 10 mg/L BAP, and 5 mg/L dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, maintained in culture for another 4 weeks, and then transferred to MSO medium in light for 2 weeks. Several pieces of callus (11-17 weeks old) are either strained through a 10 mesh sieve and put onto callus induction medium, or cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve collected the cells. The fraction collected on the sieve is plated and cultured on solid ryegrass callus induction medium for 1 week in the dark at 25° C. The callus is then transferred to and cultured on MS medium containing 1% sucrose for 2 weeks.

Transformation can be accomplished with either *Agrobacterium* of with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/L sucrose is added to the filter paper. Gold particles (1.0 μm in size) are coated with plasmid DNA according to method of Sanford et al., 1993 and delivered to the embryogenic callus with the following parameters: 500 μg particles and 2 μg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/L PPT or 50 mg/L kanamycin. Shoots resistant to the selection agent are appearing and once rotted are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

T1 or T2 generation plants are produced and are grown under the respective conditions (low temperature, drought conditions, N-limited conditions, conditions in the absence of stress as well as nutrient deficiencies), and for example subjected to experiments with limited nitrogen supply: Plants receive limited nitrogen supply by use of a nutrient depleted soil. Nutrients apart from nitrogen are supplied by a nutrient solution. For NUE assessment biomass production and/or dry matter production and/or seed yield is compared to non-transgenic wild type plants. For the other traits the procedure is adapted accordingly.

EXAMPLE 5

Engineering soybean plants with increased yield, especially enhanced stress tolerance, preferably tolerance to low temperature and/or tolerance to drought conditions, and/or enhanced nutrient use efficiency, in particular enhanced NUE and/or increased biomass production by over-expressing NUE related protein (NUERP) encoding genes from *Saccha-* romyces cerevisiae or *E. coli* or by over-expressing NUE related protein (NUERP) encoding genes from for example *Brassica napus, Glycine max, Zea mays* or *Oryza sativa*

Soybean is transformed according to the following modification of the method described in the Texas A&M U.S. Pat. No. 5,164,310. Several commercial soybean varieties are amenable to transformation by this method. The cultivar Jack (available from the Illinois Seed Foundation) is a commonly used for transformation. Seeds are sterilized by immersion in 70% (v:v) ethanol for 6 min and in 25% commercial bleach (NaOCl) supplemented with 0.1% (v:v) Tween for 20 min, followed by rinsing 4 times with sterile double distilled water. Seven-day seedlings are propagated by removing the radicle, hypocotyl and one cotyledon from each seedling. Then, the epicotyl with one cotyledon is transferred to fresh germination media in petri dishes and incubated at 25° C. under a 16-h photoperiod (approx. 100 $\mu E/m^2 s$) for three weeks. Axillary nodes (approx. 4 mm in length) were cut from 3-4 week-old plants. Axillary nodes are excised and incubated in *Agrobacterium* LBA4404 culture.

Many different binary vector systems have been described for plant transformation (e.g. An G., in *Agrobacterium* Protocols. Methods in Molecular Biology Vol. 44, p. 47-62, Gartland K. M. A. and Davey M. R. eds. Humana Press, Totowa, N.J.). Many are based on the vector pBIN19 described by Bevan (Nucleic Acid Research. 12, 8711 (1984)) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,7673,666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) can be used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Soybean plants over-expressing NUE-related genes from *Brassica napus, Glycine max, Zea mays* or *Oryza sativa* for example have higher seed yields T1 or T2 generation plants are produced and are grown under the respective conditions (low temperature, drought conditions, N-limited conditions, conditions in the absence of stress as well as nutrient deficiencies), and for example subjected to experiments with limited nitrogen supply: Plants receive limited nitrogen supply by use of a nutrient depleted soil. Nutrients apart from nitrogen are supplied by a nutrient solution. For NUE assessment biomass production and/or dry matter production and/or seed yield is compared to non-transgenic wild type plants. For the other traits the procedure is adapted accordingly.

EXAMPLE 6

Engineering Rapeseed/Canola plants with increased yield, especially enhanced stress tolerance, preferably tolerance to low temperature and/or tolerance to drought conditions, and/or enhanced nutrient use efficiency, in particular enhanced NUE and/or increased biomass production, by over-expressing NUE related protein (NUERP) encoding genes from *Saccharomyces cerevisiae* or *E. coli* or by over-expressing NUE related protein (NUERP) encoding genes from for example *Brassica napus, Glycine max, Zea mays* or *Oryza sativa*

Cotyledonary petioles and hypocotyls of 5-6 day-old young seedlings are used as explants for tissue culture and transformed according to Babic et al. (Plant Cell Rep 17, 183 (1998)). The commercial cultivar Westar (Agriculture Canada) is the standard variety used for transformation, but other varieties can be used.

*Agrobacterium tumefaciens* LBA4404 containing a binary vector can be used for canola transformation. Many different binary vector systems have been described for plant transformation (e.g. An G., in *Agrobacterium* Protocols. Methods in Molecular Biology Vol. 44, p. 47-62, Gartland K. M. A. and Davey M. R. eds. Humana Press, Totowa, N.J.). Many are based on the vector pBIN19 described by Bevan (Nucleic Acid Research. 12, 8711 (1984)) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,7673,666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) can be used to provide constitutive expression of the trait gene.

Canola seeds are surface-sterilized in 70% ethanol for 2 min., and then in 30% Clorox with a drop of Tween-20 for 10 min, followed by three rinses with sterilized distilled water. Seeds are then germinated in vitro 5 days on half strength MS medium without hormones, 1% sucrose, 0.7% Phytagar at 23° C., 16 h light. The cotyledon petiole explants with the cotyledon attached are excised from the in vitro seedlings, and inoculated with *Agrobacterium* by dipping the cut end of the petiole explant into the bacterial suspension. The explants are then cultured for 2 days on MSBAP-3 medium containing 3 mg/L BAP, 3% sucrose, 0.7% Phytagar at 23° C., 16 h light. After two days of co-cultivation with *Agrobacterium*, the petiole explants are transferred to MSBAP-3 medium containing 3 mg/L BAP, cefotaxime, carbenicillin, or timentin (300 mg/L) for 7 days, and then cultured on MSBAP-3 medium with cefotaxime, carbenicillin, or timentin and selection agent until shoot regeneration. When the shoots were 5-10 mm in length, they are cut and transferred to shoot elongation medium (MSBAP-0.5, containing 0.5 mg/L BAP). Shoots of about 2 cm in length are transferred to the rooting medium (MSO) for root induction.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

The transgenic plants are then evaluated for their enhanced increased yield, especially enhanced stress tolerance, preferably tolerance to low temperature and/or tolerance to drought conditions, and/or enhanced nutrient use efficiency, in particular NUE and/or increased biomass production, according to the method described in Example 3. It is found that transgenic rapeseed/canola over-expressing NUE related protein (NUERP) encoding genes from *Brassica napus, Glycine max, Zea mays* or *Oryza sativa* for example show an increase in yield, especially enhanced stress tolerance, preferably tolerance to low temperature and/or tolerance to drought conditions, and/or enhanced nutrient use efficiency, in particular enhanced NUE and/or increased biomass production, compared to non-transgenic control plants.

T1 or T2 generation plants are produced and are grown under the respective conditions (low temperature, drought conditions, N-limited conditions, conditions in the absence of stress as well as nutrient deficiencies), and for example subjected to experiments with limited nitrogen supply: Plants receive limited nitrogen supply by use of a nutrient depleted soil. Nutrients apart from nitrogen are supplied by a nutrient solution. For NUE assessment biomass production and/or dry matter production and/or seed yield is compared to non-transgenic wild type plants. For the other traits the procedure is adapted accordingly.

EXAMPLE 7

Engineering corn plants with increased yield, especially enhanced stress tolerance, preferably tolerance to low temperature and/or tolerance to drought conditions, and/or enhanced nutrient use efficiency, in particular enhanced NUE and/or increased biomass production, by over-expressing NUE related protein (NUERP) encoding genes from *Saccharomyces cerevisiae* or *E. coli* or by over-expressing NUE related protein (NUERP) encoding genes from for example *Brassica napus, Glycine max, Zea mays* or *Oryza sativa*

Transformation of maize (*Zea Mays* L.) is performed with a modification of the method described by Ishida et al. (Nature Biotech 14745 (1996)). Transformation is genotype-dependent in corn and only specific genotypes are amenable to transformation and regeneration. The inbred line A188 (University of Minnesota) or hybrids with A188 as a parent are good sources of donor material for transformation (Fromm et al. Biotech 8, 833 (1990)), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO 94/00977 and WO 95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

Excised embryos are grown on callus induction medium, then maize regeneration medium, containing an imidazolinone herbicide as a selection agent. The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants are then evaluated for their increased yield, especially enhanced stress tolerance, preferably tolerance to low temperature and/or tolerance to drought conditions, and/or enhanced nutrient use efficiency, in particular enhanced NUE and/or increased biomass production, according to the methods described in Example 3. The T1 generation of single locus insertions of the T-DNA will segregate for the transgene in a 3:1 ratio (more precisely in a 1:2:1 ratio). Those progeny containing one or two copies of the transgene are tolerant regarding the imidazolinone herbicide, and exhibit an increase in yield, especially enhanced stress tolerance, preferably tolerance to low temperature and/or tolerance to drought conditions, and/or enhanced nutrient use efficiency, in particular enhancement of NUE and/or increased biomass production, than those progeny lacking the transgenes.

T1 or T2 generation plants are produced and are grown under the respective conditions (low temperature, drought conditions, N-limited conditions, conditions in the absence of stress as well as nutrient deficiencies), and for example subjected to experiments with limited nitrogen supply: Plants receive limited nitrogen supply by use of a nutrient depleted soil. Nutrients apart from nitrogen are supplied by a nutrient solution. For NUE assessment biomass production and/or dry matter production and/or seed yield is compared to non-transgenic wild type plants. For the other traits the procedure is adapted accordingly. Homozygous T2 plants exhibited similar phenotypes. Hybrid plants (F1 progeny) of homozygous transgenic plants and non-transgenic plants also exhibited an increase in yield, especially enhanced stress tolerance, preferably tolerance to low temperature and/or tolerance to drought conditions, and/or enhanced nutrient use efficiency, in particular enhanced NUE efficiency.

EXAMPLE 8

Engineering wheat plants with increased yield, especially enhanced stress tolerance, preferably tolerance to low temperature and/or tolerance to drought conditions, and/or enhanced nutrient use efficiency, in particular enhanced NUE and/or increased biomass production, by over-expressing NUE related protein (NUERP) encoding genes from *Saccharomyces cerevisiae* or *E. coli* or by over-expressing NUE related protein (NUERP) encoding genes from for example *Brassica napus, Glycine max, Zea mays* or *Oryza sativa* for example Transformation of wheat is performed with the method described by Ishida et al. (Nature Biotech. 14745 (1996)). The cultivar Bobwhite (available from CYMMIT, Mexico) is commonly used in transformation. Immature embryos are co-cultivated with *Agrobacterium tumefaciens* that carry "super binary" vectors, and transgenic plants are recovered through organogenesis. The super binary vector system of Japan Tobacco is described in WO patents WO 94/00977 and WO 95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

After incubation with *Agrobacterium*, the embryos are grown on callus induction medium, then regeneration medium, containing an imidazolinone herbicide as a selection agent. The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants are then evaluated for their increased yield, especially enhanced stress tolerance, preferably tolerance to low temperature and/or tolerance to drought conditions, and/or enhanced nutrient use efficiency, in particular enhanced NUE and/or increased biomass production, according to the method described in the previous example 2. The T1 generation of single locus insertions of the T-DNA will segregate for the transgene in a 3:1 ratio (more precisely in a 1:2:1 ratio). Those progeny containing one or two copies of the transgene are tolerant regarding the imidazolinone herbicide, and exhibit an increase in yield, especially enhanced stress tolerance, preferably tolerance to low temperature and/or tolerance to drought conditions, and/or enhanced nutrient use efficiency, in particular an enhanced NUE and/or increased biomass production, than those progeny lacking the transgenes. Homozygous T2 plants exhibited similar phenotypes. Plants with an increase in yield, especially enhanced stress tolerance, preferably tolerance to low temperature and/or tolerance to drought conditions, and/or enhanced nutrient use efficiency, in particular NUE, have increased biomass production and/or dry matter production and/or seed yield under the respective conditions, like low temperature, drought conditions, limited nitrogen supply when compared to non-transgenic wild type plants. Also plants with higher yield, in the absence of stress conditions as well as in the absence of nutrient deficiencies, have increased biomass production and/or dry matter production and/or seed yield under the respective conditions.

EXAMPLE 9

Identification of Identical and Heterologous Genes

Gene sequences can be used to identify identical or heterologous genes from cDNA or genomic libraries. Identical genes (e.g. full-length cDNA clones) can be isolated via nucleic acid hybridization using for example cDNA libraries. Depending on the abundance of the gene of interest, 100,000 up to 1,000,000 recombinant bacteriophages are plated and transferred to nylon membranes. After denaturation with alkali, DNA is immobilized on the membrane by e.g. UV cross linking. Hybridization is carried out at high stringency conditions. In aqueous solution, hybridization and washing is performed at an ionic strength of 1 M NaCl and a temperature of 68° C. Hybridization probes are generated by e.g. radioactive ($^{32}P$) nick transcription labeling (High Prime, Roche, Mannheim, Germany). Signals are detected by autoradiography.

Partially identical or heterologous genes that are related but not identical can be identified in a manner analogous to the above-described procedure using low stringency hybridization and washing conditions. For aqueous hybridization, the ionic strength is normally kept at 1 M NaCl while the temperature is progressively lowered from 68 to 42° C.

Isolation of gene sequences with homology (or sequence identity/similarity) only in a distinct domain of (for example 10-20 amino acids) can be carried out by using synthetic radio labeled oligonucleotide probes. Radiolabeled oligonucleotides are prepared by phosphorylation of the 5-prime end of two complementary oligonucleotides with T4 polynucleotide kinase. The complementary oligonucleotides are annealed and ligated to form concatemers. The double stranded concatemers are than radiolabeled by, for example, nick transcription. Hybridization is normally performed at low stringency conditions using high oligonucleotide concentrations.
Oligonucleotide hybridization solution:
6×SSC
0.01 M sodium phosphate
1 mM EDTA (pH 8)
0.5% SDS
100 µg/mL denatured salmon sperm DNA
0.1% nonfat dried milk During hybridization, temperature is lowered stepwise to 5-10° C. below the estimated oligonucleotide $T_m$ or down to room temperature followed by washing steps and autoradiography. Washing is performed with low stringency such as 3 washing steps using 4×SSC. Further details are described by Sambrook J. et al., 1989, "Molecular Cloning: A Laboratory Manual," Cold Spring Harbor Laboratory Press or Ausubel F. M. et al., 1994, "Current Protocols in Molecular Biology," John Wiley & Sons.

EXAMPLE 10

Identification of Identical Genes by Screening Expression Libraries with Antibodies c-DNA clones can be used to produce recombinant polypeptide for example in *E. coli* (e.g. Qiagen QIAexpress pQE system). Recombinant polypeptides are then normally affinity purified via Ni-NTA affinity chromatography (Qiagen). Recombinant polypeptides are then used to produce specific antibodies for example by using standard techniques for rabbit immunization. Antibodies are affinity purified using a Ni-NTA column saturated with the recombinant antigen as described by Gu et al., BioTechniques 17, 257 (1994). The antibody can than be used to screen expression cDNA libraries to identify identical or heterologous genes via an immunological screening (Sambrook, J. et al., 1989, "Molecular Cloning: A Laboratory Manual," Cold Spring Harbor Laboratory Press or Ausubel, F. M. et al., 1994, "Current Protocols in Molecular Biology", John Wiley & Sons).

EXAMPLE 11

In Vivo Mutagenesis

In vivo mutagenesis of microorganisms can be performed by passage of plasmid (or other vector) DNA through *E. coli* or other microorganisms (e.g. *Bacillus* spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp W. D., DNA repair mechanisms, in: *Escherichia coli* and *Salmonella*, p. 2277-2294, ASM, 1996, Washington.) Such strains are well known to those skilled in the art. The use of such strains is illustrated, for example, in Greener A. and Callahan M., Strategies 7, 32 (1994). Transfer of mutated DNA molecules into plants is preferably done after selection and testing in microorganisms. Transgenic plants are generated according to various examples within the exemplification of this document.

EXAMPLE 12

Engineering *Arabidopsis* plants with increased yield, especially enhanced stress tolerance, preferably tolerance to low temperature and/or tolerance to drought conditions, and/or enhanced nutrient use efficiency, in particular enhanced NUE and/or increased biomass production, by over-expressing NUERP encoding genes for example from *Brassica napus, Glycine max, Zea mays* or *Oryza sativa* using tissue-specific promoters.

Transgenic *Arabidopsis* plants over-expressing NUE related protein (NUERP) encoding genes from *Brassica napus, Glycine max, Zea mays* and *Oryza sativa* for example are created as described in example 1 to express the NUE related protein (NUERP) encoding transgenes under the control of a tissue-specific promoter. T2 generation plants are produced and grown under N-limited conditions. Plants with an increase in yield, especially enhanced stress tolerance, preferably tolerance to low temperature and/or tolerance to drought conditions, and/or enhanced nutrient use efficiency, in particular NUE, have increased biomass production and/or dry matter production and/or seed yield under the respective conditions, like low temperature, drought conditions, limited nitrogen supply when compared to non-transgenic wild type plants. Also plants with higher yield, in the absence of stress conditions as well as in the absence of nutrient deficiencies, have increased biomass production and/or dry matter production and/or seed yield under the respective conditions.

EXAMPLE 13

Engineering rice plants with increased yield, especially enhanced stress tolerance, preferably tolerance to low temperature and/or tolerance to drought conditions, and/or enhanced nutrient use efficiency, in particular enhanced NUE and/or increased biomass production, by over-expressing NUE related protein (NUERP) encoding genes from *Saccharomyces cerevisiae* or *E. coli* or by over-expressing NUE related protein (NUERP) encoding genes from for example *Brassica napus, Glycine max, Zea mays* or *Oryza sativa*

The *Agrobacterium* containing the expression vector of the invention is used to transform *Oryza sativa* plants. Mature dry seeds of the rice japonica cultivar Nipponbare are dehusked. Sterilization is carried out by incubating for one minute in 70% ethanol, followed by 30 minutes in 0.2% $HgCl_2$, followed by a 6 times 15 minutes wash with sterile distilled water. The sterile seeds are then germinated on a medium containing 2,4-D (callus induction medium). After incubation in the dark for four weeks, embryogenic, scutellum-derived calli are excised and propagated on the same medium. After two weeks, the calli are multiplied or propagated by subculture on the same medium for another 2 weeks. Embryogenic callus pieces are sub-cultured on fresh medium 3 days before co-cultivation (to boost cell division activity).

*Agrobacterium* strain LBA4404 containing the expression vector of the invention is used for co-cultivation. *Agrobacterium* is inoculated on AB medium with the appropriate antibiotics and cultured for 3 days at 28° C. The bacteria are then collected and suspended in liquid co-cultivation medium to a density (OD600) of about 1. The suspension is then transferred to a Petri dish and the calli immersed in the suspension for 15 minutes. The callus tissues are then blotted dry on a filter paper and transferred to solidified, co-cultivation medium and incubated for 3 days in the dark at 25° C. Co-cultivated calli are grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential is released and shoots developed in the next four to five weeks. Shoots are excised from the calli and incubated for 2 to 3 weeks on an auxin-containing medium from which they are transferred to soil. Hardened shoots are grown under high humidity and short days in a greenhouse.

Approximately 35 independent T0 rice transformants are generated for one construct. The primary transformants are transferred from a tissue culture chamber to a greenhouse. After a quantitative PCR analysis to verify copy number of the T-DNA insert, only single copy transgenic plants that exhibit tolerance to the selection agent are kept for harvest of T1 seed. Seeds are then harvested three to five months after transplanting. The method yielded single locus transformants at a rate of over 50% (Aldemita and Hodges1996, Chan et al. 1993, Hiei et al. 1994).

For the cycling drought assay repetitive stress is applied to plants without leading to desiccation. The water supply throughout the experiment is limited and plants are subjected to cycles of drought and re-watering. For measuring biomass production, plant fresh weight is determined one day after the final watering by cutting shoots and weighing them. At an equivalent degree of drought stress, tolerant plants are able to resume normal growth whereas susceptible plants have died or suffer significant injury resulting in shorter leaves and less dry matter.

For testing the other traits according to the present invention the procedure is adapted accordingly.

FIGURES

FIG. 1*a* Vector VC-MME220-1 SEQ ID NO 1 used for cloning gene of interest for non-targeted expression.

FIG. 1*b* Vector VC-MME220-1qcz SEQ ID NO 14389 used for cloning gene of interest for non-targeted expression.

FIG. 2*a* Vector VC-MME221-1 SEQ ID NO: 2 used for cloning gene of interest for non-targeted expression.

FIG. 2*b* Vector VC-MME221-1qcz SEQ ID NO 14390 used for cloning gene of interest for non-targeted expression.

FIG. 3*a* Vector VC-MME354-1 SEQ ID NO: 3 used for cloning gene of interest for targeted expression.

FIG. 3*b* Vector VC-MME354-1QCZ SEQ ID NO 14391 used for cloning gene of interest for targeted expression.

FIG. 4*a* Vector VC-MME432-1 SEQ ID NO: 5 used for cloning gene of interest for targeted expression.

FIG. 4*b* Vector VC-MME432-1qcz SEQ ID NO 14393 used for cloning gene of interest for targeted expression.

FIG. 5*a* Vector VC-MME489-1p SEQ ID NO 15 used for cloning gene of interest for non-targeted expression and cloning of a targeting sequence.

FIG. 5*b* Vector VC-MME489-1QCZ SEQ ID NO 14395 used for cloning gene of interest for non-targeted expression and cloning of a targeting sequence.

FIG. 6 Vector pMTX0270p SEQ ID NO: 16 used for cloning of a targeting sequence.

In the sequence listing the so-called numeric identifier <223> refers some times to "transl_table=11". This is a reference to rules of translation of the coding sequences mentioned in "the Genetic Code" Item 11 "The Bacterial and Plant tissue Code (transl_table=11)" by ncbi.nlm.nih.gov/Taxonomy/Utils/wprintgc.cgi.

TABLE IA

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 1 | NUE_OEX_1 | B0017 | *E. coli* | 38 | Cytoplasmic | — |
| 1 | 2 | NUE_OEX_1 | B0045 | *E. coli* | 42 | Cytoplasmic | 44, 46, 48, 50, 52, 54, 56, 58, 60, 62, 64, 66, 68, 70, 72, 74, 76, 78, 80, 82, 84, 86, 88, 90, 92, 94, 96 |
| 1 | 3 | NUE_OEX_1 | B0180 | *E. coli* | 123 | Plastidic | 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363 |
| 1 | 4 | NUE_OEX_1 | B0242 | *E. coli* | 380 | Plastidic | 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660 |
| 1 | 5 | NUE_OEX_1 | B0403 | *E. coli* | 679 | Plastidic | 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799 |
| 1 | 6 | NUE_OEX_1 | B0474 | *E. coli* | 812 | Cytoplasmic | 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956 |
| 1 | 7 | NUE_OEX_1 | B0754 | *E. coli* | 1055 | Plastidic | 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549 |
| 1 | 8 | NUE_OEX_1 | B0784 | *E. coli* | 1563 | Cytoplasmic | 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699 |

TABLE IA-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 9 | NUE_OEX_1 | B0873 | E. coli | 1705 | Plastidic | 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829 |
| 1 | 10 | NUE_OEX_1 | B1014 | E. coli | 1844 | Cytoplasmic | 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930 |
| 1 | 11 | NUE_OEX_1 | B1020 | E. coli | 1950 | Plastidic | 1952, 1954, 1956, 1958, 1960, 1962, 1964 |
| 1 | 12 | NUE_OEX_1 | B1180 | E. coli | 1975 | Cytoplasmic | 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097 |
| 1 | 13 | NUE_OEX_1 | B1933 | E. coli | 2127 | Plastidic | 2129, 2131 |
| 1 | 14 | NUE_OEX_1 | B2032 | E. coli | 2135 | Plastidic | 2137, 2139, 2141, 2143, 2145, 2147, 2149, 2151, 2153, 2155, 2157, 2159, 2161, 2163, 2165 |
| 1 | 15 | NUE_OEX_1 | B2165 | E. coli | 2171 | Plastidic | 2173, 2175, 2177, 2179, 2181, 2183, 2185, 2187, 2189, 2191, 2193, 2195, 2197, 2199, 2201, 2203, 2205, 2207, 2209, 2211, 2213, 2215, 2217, 2219, 2221, 2223, 2225, 2227, 2229, 2231, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283 |
| 1 | 16 | NUE_OEX_1 | B2223 | E. coli | 2297 | Plastidic | 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2413, 2415, 2417 |
| 1 | 17 | NUE_OEX_1 | B2238 | E. coli | 2426 | Plastidic | 2428, 2430, 2432, 2434, 2436, 2438, 2440, 2442 |
| 1 | 17 | NUE_OEX_1 | B2238 | E. coli | 2426 | Cytoplasmic | 2428, 2430, 2432, 2434, 2436, 2438, 2440, 2442 |
| 1 | 18 | NUE_OEX_1 | B2310 | E. coli | 2452 | Plastidic | 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542 |
| 1 | 19 | NUE_OEX_1 | B2431 | E. coli | 2551 | Plastidic | 2553, 2555, 2557, 2559, 2561, 2563, 2565, 2567, 2569, 2571, 2573, 2575, 2577, 2579, 2581, 2583, 2585, 2587, 2589 |
| 1 | 20 | NUE_OEX_1 | B2600 | E. coli | 2600 | Plastidic | 2602, 2604, 2606, 2608, 2610, 2612, 2614, 2616, 2618, 2620, 2622, 2624, 2626, 2628, 2630, 2632, 2634, 2636, 2638, 2640, 2642, 2644, 2646, 2648, 2650, 2652, 2654, 2656 |
| 1 | 21 | NUE_OEX_1 | B2766 | E. coli | 2668 | Plastidic | 2670, 2672, 2674, 2676, 2678, 2680, 2682, 2684, 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764 |
| 1 | 22 | NUE_OEX_1 | B2903 | E. coli | 2772 | Cytoplasmic | 2774, 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, 2882, 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, 3016, 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094 |
| 1 | 23 | NUE_OEX_1 | B3117 | E. coli | 3117 | Plastidic | 3119, 3121, 3123, 3125, 3127, 3129, 3131, 3133, 3135, 3137, 3139, 3141, 3143, 3145, 3147, 3149, 3151, 3153, 3155, 3157, 3159, 3161, 3163, 3165, 3167, 3169, 3171, 3173, 3175, 3177, 3179, 3181, 3183, 3185, 3187, 3189, 3191, 3193, 3195, 3197, 3199, 3201, 3203, 3205, 3207, 3209, 3211, 3213, 3215, 3217, |

TABLE IA-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| | | | | | | | 3219, 3221, 3223, 3225, 3227, 3229, 3231, 3233, 3235, 3237, 3239, 3241, 3243, 3245, 3247, 3249, 3251, 3253, 3255, 3257, 3259, 3261, 3263, 3265, 3267, 3269, 3271, 3273, 3275, 3277, 3279, 3281, 3283, 3285, 3287, 3289, 3291, 3293, 3295, 3297, 3299, 3301, 3303, 3305, 3307, 3309, 3311, 3313, 3315, 3317, 3319, 3321, 3323, 3325, 3327, 3329, 3331, 3333, 3335, 3337, 3339, 3341, 3343, 3345, 3347, 3349, 3351, 3353, 3355, 3357, 3359, 3361, 3363, 3365, 3367, 3369, 3371 |
| 1 | 24 | NUE_OEX_1 | B3120 | E. coli | 3390 | Plastidic | 3392 |
| 1 | 25 | NUE_OEX_1 | B3216 | E. coli | 3396 | Plastidic | 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464 |
| 1 | 26 | NUE_OEX_1 | B3451 | E. coli | 3470 | Plastidic | 3472, 3474, 3476, 3478, 3480, 3482, 3484, 3486, 3488, 3490, 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554 |
| 1 | 27 | NUE_OEX_1 | B3791 | E. coli | 3563 | Cytoplasmic | 3565, 3567, 3569, 3571, 3573, 3575, 3577, 3579, 3581, 3583, 3585, 3587, 3589, 3591, 3593, 3595, 3597, 3599, 3601, 3603, 3605, 3607, 3609, 3611, 3613, 3615, 3617, 3619, 3621, 3623, 3625, 3627, 3629, 3631, 3633, 3635, 3637, 3639, 3641, 3643, 3645, 3647, 3649, 3651, 3653, 3655, 3657, 3659, 3661, 3663, 3665, 3667, 3669, 3671, 3673, 3675, 3677, 3679, 3681, 3683, 3685, 3687, 3689, 3691, 3693, 3695, 3697, 3699, 3701, 3703, 3705, 3707, 3709, 3711, 3713, 3715, 3717, 3719, 3721, 3723, 3725, 3727, 3729, 3731, 3733, 3735, 3737, 3739, 3741, 3743, 3745, 3747, 3749, 3751, 3753, 3755, 3757, 3759, 3761, 3763 |
| 1 | 28 | NUE_OEX_1 | B3825 | E. coli | 3770* | Plastidic | 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, 3850, 3852, 3854, 3856, 3858, 3860, 3862 |
| 1 | 29 | NUE_OEX_1 | YAL019W | S. cerevisiae | 3868 | Cytoplasmic | 3870, 3872, 3874, 3876 |
| 1 | 30 | NUE_OEX_1 | YAR035W | S. cerevisiae | 3895 | Cytoplasmic | 3897, 3899, 3901, 3903, 3905, 3907, 3909, 3911, 3913, 3915, 3917, 3919, 3921, 3923, 3925, 3927, 3929, 3931, 3933, 3935, 3937, 3939 |
| 1 | 31 | NUE_OEX_1 | YBL021C | S. cerevisiae | 3953 | Cytoplasmic | 3955, 3957, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, 4021, 4023, 4025, 4027, 4029 |
| 1 | 32 | NUE_OEX_1 | YBR055C | S. cerevisiae | 4111 | Cytoplasmic | 4113, 4115, 4117, 4119, 4121, 4123, 4125, 4127, 4129, 4131, 4133, 4135, 4137, 4139 |
| 1 | 33 | NUE_OEX_1 | YBR128C | S. cerevisiae | 4149 | Cytoplasmic | 4151, 4153, 4155 |
| 1 | 34 | NUE_OEX_1 | YBR159W | S. cerevisiae | 4162 | Cytoplasmic | 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210, 4212 |
| 1 | 35 | NUE_OEX_1 | YBR243C | S. cerevisiae | 4235 | Cytoplasmic | 4237, 4239, 4241, 4243, 4245, 4247, 4249, 4251, 4253, 4255, 4257, 4259, 4261, 4263, 4265 |
| 1 | 35 | NUE_OEX_1 | YBR243C | S. cerevisiae | 4235 | Plastidic | 4237, 4239, 4241, 4243, 4245, 4247, 4249, 4251, 4253, 4255, 4257, 4259, 4261, 4263, 4265 |
| 1 | 36 | NUE_OEX_1 | YBR262C | S. cerevisiae | 4280 | Cytoplasmic | 4282, 4284 |
| 1 | 37 | NUE_OEX_1 | YCR019W | S. cerevisiae | 4288 | Cytoplasmic | 4290, 4292, 4294, 4296, 4298, 4300, 4302, 4304 |
| 1 | 38 | NUE_OEX_1 | YDR070C | S. cerevisiae | 4315 | Cytoplasmic | 4317, 4319 |
| 1 | 39 | NUE_OEX_1 | YDR079W | S. cerevisiae | 4325 | Cytoplasmic | 4327, 4329 |
| 1 | 40 | NUE_OEX_1 | YDR123C | S. cerevisiae | 4335 | Cytoplasmic | 4337, 4339 |
| 1 | 41 | NUE_OEX_1 | YDR137W | S. cerevisiae | 4346 | Cytoplasmic | 4348, 4350 |
| 1 | 42 | NUE_OEX_1 | YDR294C | S. cerevisiae | 4361 | Cytoplasmic | 4363, 4365, 4367, 4369, 4371, 4373, 4375, 4377, 4379, 4381, 4383, 4385, 4387, 4389 |
| 1 | 42 | NUE_OEX_1 | YDR294C | S. cerevisiae | 4361 | Plastidic | 4363, 4365, 4367, 4369, 4371, 4373, 4375, 4377, 4379, 4381, 4383, 4385, 4387, 4389 |
| 1 | 43 | NUE_OEX_1 | YDR330W | S. cerevisiae | 4402 | Cytoplasmic | 4404, 4406, 4408, 4410, 4412, 4414, 4416, 4418, 4420, 4422 |
| 1 | 44 | NUE_OEX_1 | YDR355C | S. cerevisiae | 4431 | Cytoplasmic | — |
| 1 | 45 | NUE_OEX_1 | YDR430C | S. cerevisiae | 4435 | Plastidic | 4437, 4439, 4441, 4443, 4445, 4447, 4449, 4451, 4453, 4455, 4457, 4459, 4461, 4463, 4465, 4467 |
| 1 | 46 | NUE_OEX_1 | YDR472W | S. cerevisiae | 4485 | Cytoplasmic | 4487, 4489, 4491, 4493, 4495 |
| 1 | 47 | NUE_OEX_1 | YDR497C | S. cerevisiae | 4506 | Plastidic | 4508, 4510, 4512, 4514, 4516, 4518, 4520, 4522, 4524, 4526, 4528, 4530, 4532, 4534, 4536, 4538, 4540, 4542, 4544, 4546, 4548, 4550, 4552, 4554, 4556, 4558, 4560, 4562, 4564, 4566, 4568, 4570, 4572, 4574, 4576, 4578, 4580, 4582, 4584, 4586, 4588, 4590, 4592, 4594, 4596, 4598, 4600, 4602, 4604, 4606, 4608, 4610, 4612, 4614, 4616, 4618, 4620, 4622, 4624, 4626, 4628, 4630, 4632, 4634, 4636, 4638, 4640, 4642, 4644, 4646, 4648, 4650, 4652, 4654, 4656, 4658, 4660, 4662, 4664, 4666, |

TABLE IA-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| | | | | | | | 4668, 4670, 4672, 4674, 4676, 4678, 4680, 4682, 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736 |
| 1 | 48 | NUE_OEX_1 | YER029C | S. cerevisiae | 4790 | Cytoplasmic | 4792, 4794, 4796, 4798 |
| 1 | 49 | NUE_OEX_1 | YFR007W | S. cerevisiae | 4806 | Cytoplasmic | 4808, 4810, 4812, 4814, 4816, 4818, 4820, 4822, 4824, 4826, 4828 |
| 1 | 50 | NUE_OEX_1 | YGL039W | S. cerevisiae | 4836 | Cytoplasmic | 4838, 4840, 4842, 4844, 4846, 4848, 4850, 4852, 4854, 4856, 4858, 4860, 4862, 4864, 4866, 4868, 4870, 4872, 4874, 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924, 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, 5016, 5018, 5020, 5022, 5024, 5026, 5028, 5030, 5032, 5034, 5036, 5038, 5040, 5042, 5044, 5046, 5048, 5050, 5052, 5054, 5056, 5058, 5060, 5062, 5064, 5066, 5068, 5070, 5072, 5074, 5076, 5078, 5080, 5082, 5084, 5086, 5088, 5090, 5092, 5094, 5096, 5098, 5100, 5102, 5104, 5106, 5108, 5110, 5112, 5114, 5116, 5118, 5120, 5122, 5124, 5126, 5128, 5130, 5132, 5134, 5136, 5138, 5140, 5142, 5144, 5146, 5148, 5150, 5152, 5154, 5156, 5158, 5160, 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212 |
| 1 | 51 | NUE_OEX_1 | YGL043W | S. cerevisiae | 5311 | Cytoplasmic | 5313, 5315, 5317, 5319, 5321, 5323, 5325, 5327, 5329, 5331, 5333 |
| 1 | 52 | NUE_OEX_1 | YGR088W | S. cerevisiae | 5346 | Cytoplasmic | 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522 |
| 1 | 53 | NUE_OEX_1 | YGR122C-A | S. cerevisiae | 5533 | Cytoplasmic | 5535, 5537, 5539, 5541, 5543, 5545 |
| 1 | 54 | NUE_OEX_1 | YGR142W | S. cerevisiae | 5551 | Cytoplasmic | 5553, 5555 |
| 1 | 55 | NUE_OEX_1 | YGR143W | S. cerevisiae | 5559 | Cytoplasmic | 5561, 5563, 5565, 5567, 5569, 5571, 5573, 5575, 5577, 5579, 5581, 5583, 5585 |
| 1 | 56 | NUE_OEX_1 | YGR165W | S. cerevisiae | 5602 | Cytoplasmic | 5604 |
| 1 | 57 | NUE_OEX_1 | YGR170W | S. cerevisiae | 5608 | Cytoplasmic | 5610 |
| 1 | 58 | NUE_OEX_1 | YGR202C | S. cerevisiae | 5614 | Cytoplasmic | 5616, 5618, 5620, 5622, 5624, 5626, 5628, 5630, 5632, 5634, 5636, 5638, 5640, 5642, 5644, 5646, 5648, 5650, 5652, 5654, 5656, 5658 |
| 1 | 59 | NUE_OEX_1 | YGR266W | S. cerevisiae | 5666 | Cytoplasmic | 5668, 5670, 5672, 5674, 5676, 5678, 5680, 5682, 5684, 5686 |
| 1 | 60 | NUE_OEX_1 | YGR282C | S. cerevisiae | 5701 | Cytoplasmic | 5703, 5705, 5707, 5709, 5711, 5713, 5715, 5717, 5719, 5721, 5723, 5725, 5727, 5729, 5731, 5733, 5735, 5737, 5739 |
| 1 | 61 | NUE_OEX_1 | YGR290W | S. cerevisiae | 5750 | Cytoplasmic | — |
| 1 | 62 | NUE_OEX_1 | YHL021C | S. cerevisiae | 5754 | Cytoplasmic | 5756, 5758, 5760, 5762, 5764, 5766, 5768 |
| 1 | 63 | NUE_OEX_1 | YHL031C | S. cerevisiae | 5778 | Cytoplasmic | 5780, 5782, 5784, 5786, 5788, 5790, 5792, 5794, 5796, 5798, 5800, 5802, 5804, 5806 |
| 1 | 64 | NUE_OEX_1 | YHR011W | S. cerevisiae | 5812 | Cytoplasmic | 5814, 5816, 5818, 5820, 5822, 5824, 5826, 5828, 5830, 5832, 5834, 5836, 5838, 5840, 5842, 5844, 5846, 5848, 5850, 5852, 5854, 5856, 5858, 5860, 5862, 5864, 5866, 5868, 5870, 5872, 5874, 5876, 5878, 5880, 5882, 5884, 5886, 5888, 5890, 5892, 5894, 5896, 5898, 5900, 5902, 5904, 5906, 5908, 5910, 5912, 5914, 5916, 5918, 5920, 5922, 5924, 5926, 5928, 5930, 5932, 5934, 5936, 5938, 5940, 5942, 5944, 5946, 5948, 5950, 5952 |
| 1 | 65 | NUE_OEX_1 | YHR127W | S. cerevisiae | 5967 | Cytoplasmic | 5969 |
| 1 | 66 | NUE_OEX_1 | YHR137W | S. cerevisiae | 5973 | Cytoplasmic | 5975, 5977, 5979, 5981, 5983, 5985, 5987, 5989, 5991, 5993, 5995, 5997, 5999, 6001, 6003, 6005, 6007, 6009, 6011, 6013, 6015, 6017, 6019 |
| 1 | 66 | NUE_OEX_1 | YHR137W | S. cerevisiae | 5973 | Plastidic | 5975, 5977, 5979, 5981, 5983, 5985, 5987, 5989, 5991, 5993, 5995, 5997, 5999, 6001, 6003, 6005, 6007, 6009, 6011, 6013, 6015, 6017, 6019 |
| 1 | 67 | NUE_OEX_1 | YIL099W | S. cerevisiae | 6027 | Cytoplasmic | 6029, 6031, 6033, 6035, 6037, 6039, 6041, 6043, 6045, 6047, 6049, 6051, 6053, 6055, 6057, 6059, 6061, 6063, 6065, 6067, 6069, 6071, 6073, 6075, 6077, 6079, 6081, 6083, 6085, 6087, 6089, 6091, 6093, 6095, 6097 |

TABLE IA-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 67 | NUE_OEX_1 | YIL099W | S. cerevisiae | 6027 | Plastidic | 6029, 6031, 6033, 6035, 6037, 6039, 6041, 6043, 6045, 6047, 6049, 6051, 6053, 6055, 6057, 6059, 6061, 6063, 6065, 6067, 6069, 6071, 6073, 6075, 6077, 6079, 6081, 6083, 6085, 6087, 6089, 6091, 6093, 6095, 6097 |
| 1 | 68 | NUE_OEX_1 | YIL147C | S. cerevisiae | 6107 | Cytoplasmic | 6109, 6111, 6113, 6115, 6117, 6119, 6121, 6123, 6125, 6127, 6129, 6131 |
| 1 | 69 | NUE_OEX_1 | YIR034C | S. cerevisiae | 6150* | Cytoplasmic | 6152, 6154, 6156, 6158, 6160, 6162, 6164, 6166, 6168, 6170, 6172, 6174, 6176, 6178, 6180, 6182, 6184 |
| 1 | 70 | NUE_OEX_1 | YJL013C | S. cerevisiae | 6198 | Cytoplasmic | 6200, 6202, 6204 |
| 1 | 71 | NUE_OEX_1 | YJL041W | S. cerevisiae | 6208 | Cytoplasmic | 6210, 6212, 6214, 6216, 6218, 6220, 6222, 6224, 6226, 6228, 6230, 6232, 6234 |
| 1 | 72 | NUE_OEX_1 | YJL064W | S. cerevisiae | 6242 | Cytoplasmic | — |
| 1 | 73 | NUE_OEX_1 | YJL067W | S. cerevisiae | 6246 | Cytoplasmic | — |
| 1 | 74 | NUE_OEX_1 | YJL094C | S. cerevisiae | 6250 | Cytoplasmic | 6252, 6254, 6256, 6258, 6260, 6262, 6264, 6266, 6268, 6270, 6272, 6274, 6276, 6278, 6280, 6282, 6284 |
| 1 | 75 | NUE_OEX_1 | YJL171C | S. cerevisiae | 6297 | Cytoplasmic | 6299, 6301, 6303, 6305, 6307, 6309, 6311, 6313, 6315 |
| 1 | 76 | NUE_OEX_1 | YJL213W | S. cerevisiae | 6326 | Cytoplasmic | 6328, 6330, 6332, 6334, 6336, 6338, 6340, 6342, 6344, 6346, 6348, 6350, 6352, 6354, 6356, 6358, 6360, 6362, 6364, 6366, 6368, 6370, 6372, 6374, 6376, 6378, 6380, 6382, 6384, 6386, 6388, 6390, 6392, 6394, 6396, 6398, 6400, 6402, 6404, 6406, 6408, 6410, 6412, 6414, 6416, 6418, 6420, 6422, 6424, 6426, 6428, 6430, 6432, 6434, 6436, 6438, 6440, 6442, 6444, 6446, 6448, 6450, 6452, 6454, 6456, 6458, 6460, 6462, 6464, 6466, 6468, 6470, 6472, 6474, 6476, 6478, 6480 |
| 1 | 77 | NUE_OEX_1 | YJR017C | S. cerevisiae | 6488 | Cytoplasmic | 6490, 6492, 6494, 6496, 6498, 6500, 6502, 6504, 6506, 6508, 6510, 6512, 6514, 6516, 6518, 6520, 6522, 6524, 6526, 6528, 6530, 6532, 6534, 6536, 6538, 6540 |
| 1 | 78 | NUE_OEX_1 | YJR058C | S. cerevisiae | 6550 | Cytoplasmic | 6552, 6554, 6556, 6558, 6560, 6562, 6564, 6566, 6568, 6570, 6572, 6574, 6576, 6578, 6580, 6582, 6584, 6586, 6588, 6590, 6592, 6594, 6596, 6598, 6600, 6602, 6604, 6606, 6608, 6610, 6612, 6614, 6616, 6618, 6620, 6622, 6624, 6626, 6628, 6630, 6632, 6634, 6636, 6638, 6640, 6642, 6644, 6646, 6648, 6650, 6652, 6654, 6656, 6658, 6660 |
| 1 | 79 | NUE_OEX_1 | YJR117W | S. cerevisiae | 6700 | Cytoplasmic | 6702, 6704, 6706, 6708, 6710, 6712, 6714, 6716, 6718, 6720, 6722, 6724, 6726, 6728, 6730, 6732, 6734, 6736, 6738, 6740, 6742, 6744, 6746, 6748, 6750, 6752, 6754, 6756, 6758, 6760, 6762, 6764, 6766, 6768, 6770, 6772, 6774, 6776, 6778, 6780, 6782, 6784, 6786, 6788 |
| 1 | 80 | NUE_OEX_1 | YJR121W | S. cerevisiae | 6816 | Cytoplasmic | 6818, 6820, 6822, 6824, 6826, 6828, 6830, 6832, 6834, 6836, 6838, 6840, 6842, 6844, 6846, 6848, 6850, 6852, 6854, 6856, 6858, 6860, 6862, 6864, 6866, 6868, 6870, 6872, 6874, 6876, 6878, 6880, 6882, 6884, 6886, 6888, 6890, 6892, 6894, 6896, 6898, 6900, 6902, 6904, 6906, 6908, 6910, 6912, 6914, 6916, 6918, 6920, 6922, 6924, 6926, 6928, 6930, 6932, 6934, 6936, 6938, 6940, 6942, 6944, 6946, 6948, 6950, 6952, 6954, 6956, 6958, 6960, 6962, 6964, 6966, 6968, 6970, 6972, 6974, 6976, 6978, 6980, 6982, 6984, 6986, 6988, 6990, 6992, 6994, 6996, 6998, 7000, 7002, 7004, 7006, 7008, 7010, 7012, 7014, 7016, 7018, 7020, 7022, 7024, 7026, 7028, 7030, 7032, 7034, 7036, 7038, 7040, 7042, 7044, 7046, 7048, 7050, 7052, 7054, 7056, 7058, 7060, 7062, 7064, 7066, 7068, 7070, 7072, 7074, 7076, 7078, 7080, 7082, 7084, 7086, 7088, 7090, 7092, 7094, 7096, 7098, 7100, 7102, 7104, 7106, 7108, 7110, 7112, 7114, 7116, 7118, 7120, 7122, 7124, 7126, 7128, 7130, 7132, 7134, 7136, 7138, 7140, 7142, 7144, 7146, 7148, 7150, 7152, 7154, 7156, 7158, 7160, 7162, 7164, 7166, 7168, 7170, 7172, 7174, 7176, 7178, 7180, 7182, 7184, 7186, 7188, 7190, 7192, 7194, 7196, 7198, 7200, 7202, 7204, 7206, 7208, 7210, 7212, 7214, 7216, 7218, 7220, 7222, 7224, 7226, 7228, 7230, 7232, 7234, 7236, 7238, 7240, 7242, 7244, 7246, 7248, 7250, 7252, 7254, 7256, 7258, 7260, 7262, 7264, 7266, 7268, 7270, 7272, 7274, 7276, 7278, 7280, 7282, 7284, 7286, 7288, 7290, 7292, 7294, 7296, 7298, 7300, 7302, 7304, 7306, 7308, 7310, 7312, 7314, 7316, 7318, 7320, 7322, 7324, 7326, 7328, 7330, 7332, 7334 |
| 1 | 81 | NUE_OEX_1 | YJR131W | S. cerevisiae | 7366* | Cytoplasmic | 7368, 7370, 7372, 7374, 7376, 7378, 7380, 7382, 7384, 7386, 7388, 7390, 7392, 7394, 7396, 7398, 7400, 7402, 7404, 7406, 7408, 7410, 7412, 7414, 7416, 7418, 7420, 7422, 7424, 7426, 7428, 7430, 7432, 7434, 7436, 7438, 7440, 7442, 7444, 7446, 7448, 7450, 7452, 7454, 7456, 7458 |
| 1 | 82 | NUE_OEX_1 | YJR145C | S. cerevisiae | 7475 | Cytoplasmic | 7477, 7479, 7481, 7483, 7485, 7487, 7489, 7491, 7493, 7495, 7497, 7499, 7501, 7503, 7505, 7507, 7509, 7511, 7513, 7515, 7517, 7519, 7521, 7523, 7525, 7527, 7529, 7531, 7533, 7535, 7537, 7539, 7541, 7543, 7545, 7547, 7549, 7551, 7553, 7555, 7557 |

TABLE IA-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 83 | NUE_OEX_1 | YKL084W | S. cerevisiae | 7602 | Cytoplasmic | 7604, 7606, 7608, 7610, 7612, 7614, 7616, 7618, 7620, 7622, 7624, 7626, 7628, 7630, 7632, 7634, 7636, 7638, 7640, 7642, 7644 |
| 1 | 84 | NUE_OEX_1 | YKL088W | S. cerevisiae | 7651 | Cytoplasmic | 7653 |
| 1 | 85 | NUE_OEX_1 | YKL100C | S. cerevisiae | 7661* | Cytoplasmic | 7663, 7665, 7667 |
| 1 | 86 | NUE_OEX_1 | YKL131W | S. cerevisiae | 7675 | Cytoplasmic | — |
| 1 | 87 | NUE_OEX_1 | YKL138C | S. cerevisiae | 7679 | Cytoplasmic | 7681, 7683, 7685, 7687, 7689, 7691, 7693, 7695, 7697, 7699, 7701, 7703 |
| 1 | 88 | NUE_OEX_1 | YKL178C | S. cerevisiae | 7710 | Cytoplasmic | 7712, 7714, 7716, 7718 |
| 1 | 89 | NUE_OEX_1 | YKL179C | S. cerevisiae | 7735 | Cytoplasmic | 7737, 7739, 7741, 7743, 7745, 7747, 7749, 7751, 7753, 7755, 7757, 7759, 7761, 7763, 7765, 7767 |
| 1 | 90 | NUE_OEX_1 | YKL193C | S. cerevisiae | 7778* | Cytoplasmic | 7780, 7782, 7784, 7786, 7788, 7790, 7792, 7794, 7796, 7798, 7800, 7802, 7804, 7806, 7808, 7810, 7812 |
| 1 | 91 | NUE_OEX_1 | YKL216W | S. cerevisiae | 7829 | Cytoplasmic | 7831, 7833, 7835, 7837, 7839, 7841, 7843, 7845, 7847, 7849, 7851, 7853, 7855, 7857, 7859, 7861, 7863, 7865, 7867, 7869, 7871, 7873, 7875, 7877, 7879, 7881, 7883, 7885, 7887, 7889, 7891, 7893, 7895, 7897, 7899, 7901, 7903, 7905, 7907, 7909, 7911, 7913, 7915, 7917, 7919, 7921, 7923, 7925, 7927, 7929, 7931, 7933, 7935, 7937, 7939, 7941, 7943, 7945, 7947, 7949, 7951, 7953, 7955, 7957, 7959, 7961, 7963, 7965, 7967, 7969, 7971, 7973, 7975, 7977, 7979, 7981, 7983, 7985, 7987, 7989, 7991, 7993, 7995, 7997, 7999, 8001, 8003, 8005, 8007, 8009, 8011 |
| 1 | 92 | NUE_OEX_1 | YKR016W | S. cerevisiae | 8017 | Cytoplasmic | 8019, 8021, 8023, 8025, 8027, 8029, 8031, 8033, 8035, 8037 |
| 1 | 93 | NUE_OEX_1 | YKR021W | S. cerevisiae | 8045 | Cytoplasmic | 8047, 8049, 8051, 8053, 8055, 8057, 8059 |
| 1 | 94 | NUE_OEX_1 | YKR055W | S. cerevisiae | 8073 | Cytoplasmic | 8075, 8077, 8079, 8081, 8083, 8085, 8087, 8089, 8091, 8093, 8095, 8097, 8099, 8101, 8103, 8105, 8107, 8109, 8111, 8113, 8115, 8117, 8119, 8121, 8123, 8125, 8127, 8129, 8131, 8133, 8135, 8137, 8139, 8141, 8143, 8145, 8147, 8149, 8151, 8153, 8155, 8157, 8159, 8161, 8163, 8165, 8167, 8169, 8171, 8173, 8175, 8177, 8179, 8181, 8183, 8185, 8187, 8189, 8191, 8193, 8195, 8197, 8199, 8201, 8203, 8205, 8207, 8209, 8211, 8213, 8215, 8217, 8219, 8221, 8223, 8225, 8227, 8229, 8231, 8233, 8235, 8237, 8239, 8241, 8243, 8245, 8247, 8249, 8251, 8253, 8255 |
| 1 | 95 | NUE_OEX_1 | YKR088C | S. cerevisiae | 8263 | Plastidic | 8265, 8267, 8269, 8271, 8273, 8275, 8277, 8279 |
| 1 | 96 | NUE_OEX_1 | YKR093W | S. cerevisiae | 8287 | Cytoplasmic | 8289, 8291, 8293, 8295, 8297, 8299, 8301, 8303, 8305, 8307, 8309, 8311, 8313, 8315, 8317, 8319, 8321, 8323, 8325, 8327, 8329, 8331, 8333, 8335, 8337, 8339, 8341, 8343, 8345, 8347, 8349, 8351, 8353, 8355, 8357, 8359, 8361, 8363, 8365, 8367, 8369, 8371, 8373, 8375, 8377, 8379, 8381, 8383, 8385, 8387, 8389, 8391, 8393, 8395, 8397, 8399, 8401, 8403, 8405, 8407, 8409, 8411, 8413, 8415, 8417, 8419, 8421, 8423, 8425, 8427, 8429, 8431, 8433, 8435, 8437, 8439, 8441 |
| 1 | 97 | NUE_OEX_1 | YKR099W | S. cerevisiae | 8468 | Cytoplasmic | 8470, 8472 |
| 1 | 98 | NUE_OEX_1 | YKR100C | S. cerevisiae | 8484 | Cytoplasmic | 8486, 8488 |
| 1 | 99 | NUE_OEX_1 | YLL014W | S. cerevisiae | 8492 | Cytoplasmic | 8494, 8496, 8498, 8500, 8502, 8504, 8506, 8508 |
| 1 | 100 | NUE_OEX_1 | YLL016W | S. cerevisiae | 8514* | Cytoplasmic | 8516, 8518, 8520, 8522, 8524, 8526 |
| 1 | 101 | NUE_OEX_1 | YLL023C | S. cerevisiae | 8539 | Cytoplasmic | 8541, 8543, 8545, 8547, 8549, 8551, 8553, 8555, 8557, 8559, 8561, 8563, 8565 |
| 1 | 102 | NUE_OEX_1 | YLL037W | S. cerevisiae | 8571 | Cytoplasmic | — |
| 1 | 103 | NUE_OEX_1 | YLL049W | S. cerevisiae | 8575 | Cytoplasmic | — |
| 1 | 104 | NUE_OEX_1 | YLL055W | S. cerevisiae | 8579 | Cytoplasmic | 8581, 8583, 8585, 8587, 8589, 8591, 8593, 8595, 8597, 8599, 8601, 8603, 8605, 8607, 8609, 8611, 8613, 8615, 8617, 8619, 8621, 8623, 8625, 8627, 8629, 8631, 8633, 8635, 8637, 8639, 8641, 8643, 8645, 8647, 8649, 8651, 8653, 8655 |
| 1 | 105 | NUE_OEX_1 | YLR034C | S. cerevisiae | 8661* | Cytoplasmic | 8663, 8665, 8667, 8669, 8671, 8673, 8675, 8677, 8679, 8681, 8683, 8685, 8687, 8689, 8691, 8693, 8695, 8697, 8699, 8701, 8703, 8705, 8707, 8709, 8711, 8713, 8715, 8717, 8719, 8721, 8723, 8725, 8727, 8729, 8731, 8733, 8735, 8737, 8739, 8741, 8743, 8745, 8747, 8749, 8751, 8753, 8755, 8757, 8759, 8761, 8763, 8765, 8767, 8769, 8771, 8773, 8775, 8777, 8779, 8781, 8783, 8785, 8787, 8789, 8791, 8793, 8795, 8797, 8799, 8801, 8803, 8805, 8807, 8809, 8811, 8813, 8815, 8817, 8819, 8821, 8823, 8825, 8827, 8829, 8831, 8833, 8835, 8837, 8839, 8841, 8843, 8845, 8847, 8849, 8851, 8853, 8855, 8857, 8859, 8861, 8863, 8865, 8867, 8869, 8871, 8873, 8875, 8877, 8879, 8881, 8883, 8885, 8887, 8889, 8891, 8893, 8895, 8897, 8899, 8901, 8903, 8905, 8907, 8909, 8911, 8913, 8915, 8917, 8919, 8921, 8923, 8925, 8927, 8929, 8931, 8933, 8935, 8937, 8939, 8941, 8943, 8945, 8947, 8949, 8951, 8953, 8955, 8957, 8959, 8961 |
| 1 | 106 | NUE_OEX_1 | YLR042C | S. cerevisiae | 8991 | Cytoplasmic | — |
| 1 | 107 | NUE_OEX_1 | YLR053C | S. cerevisiae | 8995 | Cytoplasmic | — |

TABLE IA-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 108 | NUE_OEX_1 | YLR058C | S. cerevisiae | 8999 | Cytoplasmic | 9001, 9003, 9005, 9007, 9009, 9011, 9013, 9015, 9017, 9019, 9021, 9023, 9025, 9027, 9029, 9031, 9033, 9035, 9037, 9039, 9041, 9043, 9045, 9047, 9049, 9051, 9053, 9055, 9057, 9059, 9061, 9063, 9065, 9067, 9069, 9071, 9073, 9075, 9077, 9079, 9081, 9083, 9085, 9087, 9089, 9091, 9093, 9095, 9097, 9099, 9101, 9103, 9105, 9107, 9109, 9111, 9113, 9115, 9117, 9119, 9121, 9123, 9125, 9127, 9129, 9131, 9133, 9135, 9137, 9139, 9141, 9143, 9145, 9147, 9149, 9151, 9153, 9155, 9157, 9159, 9161, 9163, 9165, 9167, 9169, 9171, 9173, 9175, 9177, 9179, 9181, 9183, 9185, 9187, 9189, 9191, 9193, 9195, 9197, 9199, 9201, 9203, 9205, 9207, 9209, 9211, 9213, 9215, 9217, 9219, 9221, 9223, 9225, 9227, 9229, 9231, 9233, 9235, 9237, 9239, 9241, 9243, 9245, 9247, 9249, 9251, 9253, 9255, 9257, 9259, 9261, 9263, 9265, 9267, 9269, 9271, 9273, 9275, 9277, 9279, 9281, 9283, 9285, 9287, 9289, 9291, 9293, 9295, 9297, 9299, 9301, 9303, 9305, 9307, 9309, 9311, 9313, 9315, 9317, 9319, 9321, 9323, 9325, 9327, 9329, 9331, 9333, 9335, 9337, 9339, 9341, 9343, 9345, 9347, 9349, 9351, 9353, 9355, 9357, 9359, 9361, 9363, 9365, 9367, 9369, 9371, 9373, 9375, 9377, 9379, 9381, 9383, 9385, 9387, 9389, 9391, 9393, 9395, 9397, 9399, 9401, 9403, 9405, 9407, 9409, 9411, 9413, 9415, 9417, 9419, 9421, 9423, 9425, 9427, 9429, 9431, 9433, 9435, 9437, 9439, 9441, 9443, 9445, 9447, 9449, 9451, 9453, 9455, 9457, 9459, 9461, 9463, 9465, 9467, 9469, 9471, 9473, 9475, 9477, 9479, 9481, 9483, 9485, 9487, 9489, 9491, 9493, 9495, 9497, 9499 |
| 1 | 109 | NUE_OEX_1 | YLR060W | S. cerevisiae | 9551* | Cytoplasmic | 9553, 9555, 9557, 9559, 9561, 9563, 9565, 9567, 9569, 9571, 9573, 9575, 9577, 9579, 9581, 9583, 9585, 9587, 9589, 9591, 9593, 9595, 9597, 9599, 9601, 9603, 9605, 9607, 9609, 9611, 9613, 9615, 9617, 9619, 9621, 9623, 9625, 9627 |
| 1 | 110 | NUE_OEX_1 | YLR065C | S. cerevisiae | 9637 | Cytoplasmic | 9639, 9641, 9643, 9645, 9647, 9649, 9651, 9653, 9655, 9657, 9659, 9661, 9663, 9665, 9667 |
| 1 | 111 | NUE_OEX_1 | YLR070C | S. cerevisiae | 9672 | Cytoplasmic | 9674, 9676, 9678, 9680, 9682, 9684, 9686, 9688, 9690, 9692, 9694, 9696, 9698, 9700, 9702, 9704, 9706, 9708, 9710, 9712, 9714, 9716, 9718, 9720, 9722, 9724, 9726, 9728, 9730, 9732, 9734, 9736, 9738, 9740, 9742, 9744, 9746, 9748, 9750, 9752, 9754, 9756, 9758, 9760, 9762, 9764, 9766, 9768, 9770, 9772, 9774, 9776, 9778, 9780, 9782, 9784, 9786, 9788, 9790, 9792, 9794, 9796, 9798, 9800, 9802, 9804, 9806, 9808, 9810, 9812, 9814, 9816, 9818, 9820, 9822, 9824, 9826, 9828, 9830, 9832, 9834, 9836, 9838, 9840, 9842, 9844, 9846, 9848, 9850, 9852, 9854, 9856, 9858, 9860, 9862, 9864, 9866, 9868, 9870, 9872, 9874, 9876, 9878, 9880, 9882, 9884, 9886, 9888, 9890, 9892, 9894, 9896, 9898, 9900, 9902, 9904, 9906, 9908, 9910, 9912, 9914, 9916, 9918, 9920, 9922, 9924, 9926, 9928, 9930, 9932, 9934, 9936, 9938, 9940, 9942, 9944, 9946, 9948, 9950, 9952, 9954, 9956, 9958, 9960, 9962, 9964, 9966, 9968, 9970, 9972, 9974, 9976, 9978, 9980, 9982, 9984, 9986, 9988, 9990, 9992, 9994, 9996, 9998, 10000, 10002, 10004, 10006, 10008, 10010, 10012, 10014, 10016, 10018, 10020, 10022, 10024, 10026, 10028, 10030, 10032, 10034, 10036, 10038, 10040, 10042, 10044, 10046, 10048, 10050, 10052, 10054, 10056, 10058, 10060, 10062, 10064, 10066, 10068, 10070, 10072, 10074, 10076, 10078, 10080, 10082, 10084, 10086, 10088, 10090, 10092, 10094, 10096, 10098, 10100, 10102, 10104, 10106, 10108, 10110, 10112, 10114, 10116 |
| 1 | 112 | NUE_OEX_1 | YLR100W | S. cerevisiae | 10182 | Cytoplasmic | 10184, 10186, 10188, 10190, 10192, 10194, 10196, 10198, 10200, 10202 |
| 1 | 113 | NUE_OEX_1 | YLR109W | S. cerevisiae | 10214 | Cytoplasmic | 10216, 10218, 10220, 10222, 10224, 10226, 10228, 10230, 10232, 10234, 10236, 10238, 10240, 10242, 10244, 10246, 10248, 10250, 10252, 10254, 10256, 10258, 10260, 10262, 10264, 10266, 10268, 10270, 10272, 10274, 10276, 10278, 10280, 10282, 10284, 10286, 10288, 10290, 10292, 10294, 10296, 10298, 10300, 10302, 10304, 10306, 10308, 10310, 10312, 10314, 10316, 10318, 10320, 10322, 10324, 10326, 10328, 10330, 10332, 10334, 10336, 10338, 10340, 10342, 10344, 10346, 10348, 10350, 10352, 10354, 10356, 10358, 10360, 10362, 10364, 10366, 10368, 10370, 10372, 10374, 10376, 10378, 10380, 10382, 10384, 10386, 10388, 10390, 10392, 10394, 10396, 10398, 10400, 10402, 10404, 10406, 10408, 10410, 10412, 10414, 10416 |
| 1 | 114 | NUE_OEX_1 | YLR125W | S. cerevisiae | 10447 | Cytoplasmic | — |
| 1 | 115 | NUE_OEX_1 | YLR127C | S. cerevisiae | 10451 | Cytoplasmic | 10453, 10455, 10457, 10459 |

TABLE IA-continued

Nucleic acid sequence ID numbers

| Appli-cation | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 116 | NUE_OEX_1 | YLR185W | S. cerevisiae | 10463 | Cytoplasmic | 10465, 10467, 10469, 10471, 10473, 10475, 10477, 10479, 10481, 10483, 10485, 10487, 10489, 10491, 10493, 10495, 10497, 10499, 10501, 10503, 10505, 10507, 10509, 10511 |
| 1 | 117 | NUE_OEX_1 | YLR204W | S. cerevisiae | 10533 | Cytoplasmic | 10535, 10537 |
| 1 | 117 | NUE_OEX_1 | YLR204W | S. cerevisiae | 10533 | Plastidic | 10535, 10537 |
| 1 | 118 | NUE_OEX_1 | YLR242C | S. cerevisiae | 10541 | Cytoplasmic | 10543, 10545, 10547, 10549, 10551, 10553 |
| 1 | 119 | NUE_OEX_1 | YLR293C | S. cerevisiae | 10562 | Cytoplasmic | 10564, 10566, 10568, 10570, 10572, 10574, 10576, 10578, 10580, 10582, 10584, 10586, 10588, 10590, 10592, 10594, 10596, 10598, 10600, 10602, 10604, 10606, 10608, 10610, 10612, 10614, 10616, 10618, 10620, 10622, 10624, 10626, 10628, 10630, 10632, 10634, 10636, 10638, 10640, 10642, 10644, 10646, 10648, 10650, 10652, 10654, 10656, 10658, 10660, 10662, 10664, 10666, 10668, 10670, 10672, 10674, 10676, 10678, 10680, 10682, 10684, 10686, 10688, 10690, 10692, 10694, 10696, 10698, 10700, 10702, 10704, 10706, 10708, 10710, 10712 |
| 1 | 120 | NUE_OEX_1 | YLR313C | S. cerevisiae | 10990 | Cytoplasmic | 10992, 10994 |
| 1 | 121 | NUE_OEX_1 | YLR315W | S. cerevisiae | 10998 | Cytoplasmic | 11000 |
| 1 | 122 | NUE_OEX_1 | YLR329W | S. cerevisiae | 11004 | Cytoplasmic | 11006, 11008 |
| 1 | 123 | NUE_OEX_1 | YLR362W | S. cerevisiae | 11012 | Cytoplasmic | 11014, 11016, 11018, 11020, 11022, 11024, 11026, 11028, 11030, 11032, 11034, 11036, 11038, 11040, 11042 |
| 1 | 124 | NUE_OEX_1 | YLR395C | S. cerevisiae | 11054 | Cytoplasmic | 11056, 11058, 11060 |
| 1 | 125 | NUE_OEX_1 | YLR404W | S. cerevisiae | 11066 | Cytoplasmic | 11068, 11070 |
| 1 | 126 | NUE_OEX_1 | YLR463C | S. cerevisiae | 11074 | Cytoplasmic | 11076 |
| 1 | 127 | NUE_OEX_1 | YML022W | S. cerevisiae | 11080 | Cytoplasmic | 11082, 11084, 11086, 11088, 11090, 11092, 11094, 11096, 11098, 11100, 11102, 11104, 11106, 11108, 11110, 11112, 11114, 11116, 11118, 11120, 11122, 11124, 11126, 11128, 11130, 11132, 11134, 11136, 11138, 11140, 11142, 11144, 11146, 11148, 11150, 11152, 11154, 11156, 11158, 11160, 11162, 11164, 11166, 11168, 11170, 11172, 11174, 11176, 11178, 11180, 11182, 11184, 11186, 11188, 11190, 11192, 11194, 11196, 11198, 11200, 11202, 11204, 11206, 11208, 11210, 11212, 11214, 11216, 11218, 11220, 11222, 11224, 11226, 11228, 11230, 11232, 11234, 11236, 11238, 11240, 11242, 11244, 11246, 11248, 11250, 11252, 11254, 11256, 11258, 11260, 11262, 11264, 11266, 11268, 11270, 11272, 11274, 11276, 11278, 11280, 11282, 11284, 11286, 11288, 11290, 11292, 11294, 11296, 11298, 11300, 11302, 11304, 11306, 11308, 11310, 11312, 11314, 11316, 11318, 11320, 11322, 11324, 11326, 11328, 11330, 11332, 11334, 11336, 11338, 11340, 11342, 11344, 11346, 11348, 11350, 11352, 11354, 11356, 11358, 11360, 11362, 11364, 11366, 11368, 11370, 11372, 11374, 11376, 11378, 11380, 11382, 11384, 11386, 11388, 11390, 11392, 11394, 11396, 11398, 11400, 11402, 11404, 11406, 11408, 11410, 11412, 11414, 11416, 11418, 11420, 11422, 11424, 11426, 11428, 11430, 11432, 11434, 11436, 11438, 11440, 11442, 11444, 11446, 11448, 11450, 11452, 11454, 11456, 11458, 11460, 11462, 11464, 11466, 11468, 11470, 11472, 11474, 11476, 11478, 11480, 11482, 11484, 11486, 11488, 11490, 11492, 11494, 11496, 11498, 11500, 11502, 11504, 11506, 11508, 11510, 11512, 11514, 11516, 11518, 11520, 11522, 11524 |
| 1 | 128 | NUE_OEX_1 | YML027W | S. cerevisiae | 11552 | Cytoplasmic | 11554, 11556, 11558, 11560, 11562 |
| 1 | 129 | NUE_OEX_1 | YML065W | S. cerevisiae | 11569 | Cytoplasmic | 11571, 11573, 11575, 11577, 11579, 11581, 11583, 11585 |
| 1 | 130 | NUE_OEX_1 | YML089C | S. cerevisiae | 11596 | Cytoplasmic | — |
| 1 | 131 | NUE_OEX_1 | YML128C | S. cerevisiae | 11600 | Cytoplasmic | 11602, 11604, 11606, 11608 |
| 1 | 132 | NUE_OEX_1 | YMR011W | S. cerevisiae | 11612 | Cytoplasmic | 11614, 11616, 11618, 11620, 11622, 11624, 11626, 11628, 11630, 11632, 11634, 11636, 11638, 11640, 11642, 11644, 11646, 11648, 11650, 11652, 11654, 11656, 11658, 11660, 11662, 11664, 11666, 11668, 11670, 11672, 11674, 11676, 11678, 11680, 11682, 11684, 11686, 11688, 11690, 11692, 11694, 11696, 11698, 11700, 11702, 11704, 11706, 11708, 11710, 11712, 11714, 11716, 11718, 11720, 11722, 11724, 11726, 11728, 11730, 11732, 11734, 11736, 11738, 11740, 11742, 11744, 11746, 11748, 11750, 11752, 11754, 11756, 11758, 11760, 11762, 11764, 11766, 11768, 11770, 11772, 11774, 11776, 11778, 11780, 11782, 11784, 11786, 11788, 11790, 11792, 11794, 11796, 11798, 11800, 11802, 11804, 11806, 11808, 11810, 11812, 11814, 11816, 11818, 11820, 11822, 11824, 11826, 11828, 11830, 11832, 11834, 11836, 11838, 11840, 11842, 11844, 11846, 11848, 11850, 11852, 11854, 11856, 11858, 11860, 11862, 11864, 11866, 11868, 11870, 11872, 11874, 11876, 11878, 11880, 11882, 11884, 11886, 11888, 11890, 11892, 11894, 11896, 11898, 11900, |

TABLE IA-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| | | | | | | | 11902, 11904, 11906, 11908, 11910, 11912, 11914, 11916, 11918, 11920, 11922, 11924, 11926, 11928, 11930, 11932, 11934, 11936, 11938, 11940, 11942, 11944, 11946, 11948, 11950, 11952, 11954, 11956, 11958, 11960, 11962, 11964, 11966, 11968, 11970, 11972, 11974, 11976, 11978, 11980, 11982, 11984, 11986, 11988, 11990, 11992, 11994, 11996, 11998, 12000, 12002, 12004, 12006, 12008, 12010, 12012, 12014, 12016, 12018, 12020, 12022, 12024, 12026, 12028, 12030, 12032, 12034, 12036, 12038, 12040, 12042, 12044, 12046, 12048, 12050, 12052, 12054, 12056, 12058, 12060, 12062, 12064, 12066, 12068, 12070, 12072, 12074, 12076, 12078, 12080, 12082, 12084, 12086, 12088, 12090, 12092, 12094, 12096, 12098, 12100, 12102, 12104, 12106, 12108, 12110, 12112, 12114, 12116, 12118, 12120, 12122 |
| 1 | 133 | NUE_OEX_1 | YMR037C | S. cerevisiae | 12246 | Cytoplasmic | 12248, 12250, 12252, 12254 |
| 1 | 134 | NUE_OEX_1 | YMR049C | S. cerevisiae | 12263 | Cytoplasmic | 12265, 12267, 12269, 12271, 12273, 12275, 12277, 12279, 12281, 12283, 12285, 12287, 12289, 12291, 12293, 12295, 12297 |
| 1 | 135 | NUE_OEX_1 | YMR052W | S. cerevisiae | 12316 | Cytoplasmic | 12318, 12320 |
| 1 | 136 | NUE_OEX_1 | YMR082C | S. cerevisiae | 12327* | Cytoplasmic | — |
| 1 | 137 | NUE_OEX_1 | YMR125W | S. cerevisiae | 12331 | Cytoplasmic | 12333, 12335, 12337, 12339, 12341, 12343, 12345, 12347, 12349, 12351, 12353, 12355, 12357, 12359, 12361, 12363, 12365 |
| 1 | 138 | NUE_OEX_1 | YMR126C | S. cerevisiae | 12378 | Cytoplasmic | 12380, 12382, 12384 |
| 1 | 139 | NUE_OEX_1 | YMR144W | S. cerevisiae | 12394 | Cytoplasmic | 12396, 12398 |
| 1 | 140 | NUE_OEX_1 | YMR160W | S. cerevisiae | 12406 | Cytoplasmic | 12408, 12410 |
| 1 | 141 | NUE_OEX_1 | YMR191W | S. cerevisiae | 12414 | Cytoplasmic | 12416 |
| 1 | 142 | NUE_OEX_1 | YMR209C | S. cerevisiae | 12420 | Cytoplasmic | 12422, 12424, 12426, 12428 |
| 1 | 143 | NUE_OEX_1 | YMR233W | S. cerevisiae | 12440 | Cytoplasmic | 12442, 12444, 12446, 12448, 12450, 12452, 12454, 12456, 12458, 12460, 12462, 12464 |
| 1 | 144 | NUE_OEX_1 | YMR278W | S. cerevisiae | 12470 | Cytoplasmic | 12472, 12474, 12476, 12478, 12480, 12482, 12484, 12486, 12488, 12490, 12492, 12494, 12496, 12498, 12500, 12502, 12504, 12506, 12508, 12510, 12512, 12514, 12516, 12518, 12520, 12522, 12524, 12526, 12528, 12530, 12532, 12534, 12536, 12538, 12540, 12542, 12544, 12546, 12548, 12550, 12552, 12554, 12556, 12558, 12560, 12562, 12564, 12566, 12568, 12570, 12572, 12574, 12576, 12578, 12580, 12582, 12584, 12586, 12588, 12590, 12592, 12594, 12596, 12598, 12600, 12602, 12604, 12606, 12608, 12610, 12612, 12614, 12616, 12618, 12620, 12622, 12624, 12626, 12628, 12630, 12632, 12634, 12636, 12638, 12640, 12642, 12644, 12646, 12648, 12650, 12652, 12654, 12656, 12658, 12660, 12662, 12664, 12666, 12668, 12670, 12672, 12674, 12676, 12678, 12680, 12682, 12684, 12686, 12688, 12690, 12692, 12694, 12696, 12698, 12700, 12702, 12704, 12706, 12708, 12710, 12712, 12714, 12716, 12718, 12720, 12722, 12724, 12726, 12728, 12730, 12732, 12734, 12736, 12738 |
| 1 | 145 | NUE_OEX_1 | YMR280C | S. cerevisiae | 12749 | Cytoplasmic | 12751, 12753, 12755 |
| 1 | 146 | NUE_OEX_1 | YNL014W | S. cerevisiae | 12773 | Cytoplasmic | 12775, 12777, 12779, 12781, 12783, 12785, 12787, 12789, 12791, 12793, 12795, 12797, 12799, 12801, 12803, 12805, 12807, 12809 |
| 1 | 147 | NUE_OEX_1 | YNL320W | S. cerevisiae | 12829 | Cytoplasmic | 12831, 12833, 12835, 12837, 12839, 12841, 12843, 12845, 12847, 12849, 12851, 12853, 12855, 12857, 12859, 12861, 12863, 12865 |
| 1 | 148 | NUE_OEX_1 | YOL007C | S. cerevisiae | 12883 | Cytoplasmic | 12885 |
| 1 | 149 | NUE_OEX_1 | YOL164W | S. cerevisiae | 12889 | Cytoplasmic | 12891, 12893, 12895, 12897, 12899, 12901, 12903, 12905, 12907, 12909, 12911, 12913, 12915, 12917, 12919, 12921, 12923, 12925, 12927, 12929, 12931, 12933, 12935, 12937, 12939, 12941, 12943, 12945, 12947, 12949, 12951, 12953, 12955, 12957, 12959, 12961, 12963, 12965, 12967, 12969, 12971, 12973, 12975, 12977, 12979, 12981, 12983, 12985, 12987, 12989, 12991, 12993, 12995, 12997, 12999 |
| 1 | 150 | NUE_OEX_1 | YOR076C | S. cerevisiae | 13014 | Cytoplasmic | — |
| 1 | 151 | NUE_OEX_1 | YOR083W | S. cerevisiae | 13018 | Cytoplasmic | 13020 |
| 1 | 152 | NUE_OEX_1 | YOR097C | S. cerevisiae | 13024 | Cytoplasmic | 13026 |
| 1 | 153 | NUE_OEX_1 | YOR128C | S. cerevisiae | 13030 | Cytoplasmic | 13032, 13034, 13036, 13038, 13040, 13042, 13044, 13046, 13048, 13050, 13052, 13054, 13056, 13058, 13060, 13062, 13064, 13066, 13068, 13070, 13072, 13074, 13076, 13078, 13080, 13082, 13084, 13086, 13088, 13090, 13092, 13094, 13096 |
| 1 | 154 | NUE_OEX_1 | YOR353C | S. cerevisiae | 14085 | Cytoplasmic | 14087, 14089 |
| 1 | 155 | NUE_OEX_1 | YPL141C | S. cerevisiae | 14093 | Cytoplasmic | 14095, 14097, 14099 |
| 1 | 156 | NUE_OEX_1 | YPR088C | S. cerevisiae | 14113 | Cytoplasmic | 14115, 14117, 14119, 14121, 14123, 14125, 14127, 14129, 14131, 14133, 14135, 14137, 14139, 14141, 14143, 14145, |

TABLE IA-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| | | | | | | | 14147, 14149, 14151, 14153, 14155, 14157, 14159, 14161, 14163, 14165, 14167, 14169, 14171, 14173, 14175, 14177, 14179, 14181, 14183, 14185, 14187, 14189, 14191, 14193, 14195, 14197, 14199, 14201, 14203, 14205, 14207, 14209, 14211, 14213 |
| 1 | 157 | NUE_OEX_1 | YPR108W | S. cerevisiae | 14246 | Cytoplasmic | 14248, 14250, 14252, 14254, 14256, 14258, 14260, 14262, 14264, 14266, 14268, 14270, 14272, 14274, 14276, 14278, 14280, 14282, 14284, 14286, 14288 |
| 1 | 158 | NUE_OEX_1 | YPR110C | S. cerevisiae | 14311 | Cytoplasmic | 14313, 14315, 14317, 14319, 14321, 14323, 14325, 14327, 14329, 14331, 14333, 14335, 14337, 14339, 14341, 14343, 14345, 14347, 14349, 14351, 14353, 14355, 14357, 14359, 14361, 14363, 14365, 14367, 14369, 14371 |
| 1 | 159 | NUE_OEX_1 | B3825_2 | E. coli | 14914 | Plastidic | 14916, 14918, 14920, 14922, 14924, 14926, 14928, 14930, 14932, 14934, 14936, 14938, 14940, 14942, 14944, 14946, 14948, 14950, 14952, 14954, 14956, 14958, 14960, 14962, 14964, 14966, 14968, 14970, 14972, 14974, 14976, 14978, 14980, 14982, 14984, 14986, 14988, 14990, 14992, 14994, 14996, 14998, 15000, 15002, 15004, 15006, 15008 |
| 1 | 160 | NUE_OEX_1 | YIR034C_2 | S. cerevisiae | 15382 | Cytoplasmic | 15384, 15386, 15388, 15390, 15392, 15394, 15396, 15398, 15400, 15402, 15404, 15406, 15408, 15410, 15412, 15414, 15416, 15418 |
| 1 | 161 | NUE_OEX_1 | YJR131W_2 | S. cerevisiae | 15460 | Cytoplasmic | 15462, 15464, 15466, 15468, 15470, 15472, 15474, 15476, 15478, 15480, 15482, 15484, 15486, 15488, 15490, 15492, 15494, 15496, 15498, 15500, 15502, 15504, 15506, 15508, 15510, 15512, 15514, 15516, 15518, 15520, 15522, 15524, 15526, 15528, 15530, 15532, 15534, 15536, 15538, 15540, 15542, 15544, 15546, 15548, 15550, 15552, 15554 |
| 1 | 162 | NUE_OEX_1 | YKL100C_2 | S. cerevisiae | 15571 | Cytoplasmic | 15573, 15575, 15577, 15579 |
| 1 | 163 | NUE_OEX_1 | YKL193C_2 | S. cerevisiae | 15593 | Cytoplasmic | 15595, 15597, 15599, 15601, 15603, 15605, 15607, 15609, 15611, 15613, 15615, 15617, 15619, 15621, 15623, 15625, 15627, 15629 |
| 1 | 164 | NUE_OEX_1 | YLL016W_2 | S. cerevisiae | 15646 | Cytoplasmic | 15648, 15650, 15652, 15654, 15656, 15658, 15660 |
| 1 | 165 | NUE_OEX_1 | YLR034C_2 | S. cerevisiae | 15673 | Cytoplasmic | 15675, 15677, 15679, 15681, 15683, 15685, 15687, 15689, 15691, 15693, 15695, 15697, 15699, 15701, 15703, 15705, 15707, 15709, 15711, 15713, 15715, 15717, 15719, 15721, 15723, 15725, 15727, 15729, 15731, 15733, 15735, 15737, 15739, 15741, 15743, 15745, 15747, 15749, 15751, 15753, 15755, 15757, 15759, 15761, 15763, 15765, 15767, 15769, 15771, 15773, 15775, 15777, 15779, 15781, 15783, 15785, 15787, 15789, 15791, 15793, 15795, 15797, 15799, 15801, 15803, 15805, 15807, 15809, 15811, 15813, 15815, 15817, 15819, 15821, 15823, 15825, 15827, 15829, 15831, 15833, 15835, 15837, 15839, 15841, 15843, 15845, 15847, 15849, 15851, 15853, 15855, 15857, 15859, 15861, 15863, 15865, 15867, 15869, 15871, 15873, 15875, 15877, 15879, 15881, 15883, 15885, 15887, 15889, 15891, 15893, 15895, 15897, 15899, 15901, 15903, 15905, 15907, 15909, 15911, 15913, 15915, 15917, 15919, 15921, 15923, 15925, 15927, 15929, 15931, 15933, 15935, 15937, 15939, 15941, 15943, 15945, 15947, 15949, 15951, 15953, 15955, 15957, 15959, 15961, 15963, 15965, 15967, 15969, 15971, 15973, 15975 |
| 1 | 166 | NUE_OEX_1 | YLR060W_2 | S. cerevisiae | 16005 | Cytoplasmic | 16007, 16009, 16011, 16013, 16015, 16017, 16019, 16021, 16023, 16025, 16027, 16029, 16031, 16033, 16035, 16037, 16039, 16041, 16043, 16045, 16047, 16049, 16051, 16053, 16055, 16057, 16059, 16061, 16063, 16065, 16067, 16069, 16071, 16073, 16075, 16077, 16079, 16081, 16083 |
| 1 | 167 | NUE_OEX_1 | YMR082C_2 | S. cerevisiae | 16114 | Cytoplasmic | 16116 |
| 1 | 168 | NUE_OEX_1 | B1258 | E. coli | 14402 | Cytoplasmic | 14404, 14406, 14408, 14410, 14412, 14414, 14416, 14418, 14420, 14422, 14424, 14426, 14428, 14430, 14432, 14434, 14436, 14438, 14440, 14442, 14444, 14446, 14448, 14450, 14452, 14454, 14456, 14458, 14460, 14462, 14464, 14466, 14468, 14470, 14472, 14474, 14476, 14478, 14480, 14482, 14484, 14486, 14488, 14490 |
| 1 | 169 | NUE_OEX_1 | YML101C | S. cerevisiae | 16093 | Cytoplasmic | 16095, 16097, 16099 |
| 1 | 170 | NUE_OEX_1 | YMR065W | S. cerevisiae | 16106 | Cytoplasmic | 16108, 16110 |
| 1 | 171 | NUE_OEX_1 | YMR163C | S. cerevisiae | 16120 | Cytoplasmic | 16122, 16124, 16126 |
| 1 | 172 | NUE_OEX_1 | YOL042W | S. cerevisiae | 16275 | Cytoplasmic | 16277, 16279, 16281, 16283, 16285, 16287 |
| 1 | 173 | NUE_OEX_1 | YOR226C | S. cerevisiae | 16305 | Cytoplasmic | 16307, 16309, 16311, 16313, 16315, 16317, 16319, 16321, 16323, 16325, 16327, 16329, 16331, 16333, 16335, 16337, 16339, 16341, 16343, 16345, 16347, 16349, 16351, 16353, 16355, 16357, 16359, 16361, 16363, 16365, 16367, 16369, 16371, 16373, 16375, 16377, 16379, 16381, 16383, 16385, 16387, 16389, 16391, 16393, 16395, 16397, 16399, 16401, 16403, 16405, 16407, 16409, 16411, 16413, 16415, 16417, |

TABLE IA-continued

Nucleic acid sequence ID numbers

| Appli-cation | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| | | | | | | | 16419, 16421, 16423, 16425, 16427, 16429, 16431, 16433, 16435, 16437, 16439, 16441, 16443, 16445, 16447, 16449, 16451, 16453, 16455, 16457, 16459, 16461, 16463, 16465, 16467, 16469, 16471, 16473, 16475, 16477, 16479, 16481, 16483, 16485, 16487, 16489, 16491, 16493, 16495, 16497, 16499, 16501, 16503, 16505, 16507, 16509, 16511, 16513, 16515, 16517, 16519, 16521, 16523, 16525, 16527, 16529, 16531, 16533, 16535 |
| 1 | 174 | NUE_OEX_1 | YPL068C | S. cerevisiae | 16573 | Cytoplasmic | 16575, 16577 |
| 1 | 175 | NUE_OEX_1 | B0165 | E. coli | 14396 | Plastidic | 14398 |
| 1 | 176 | NUE_OEX_1 | YOR203W | S. cerevisiae | 16299 | Cytoplasmic | 16301 |
| 1 | 177 | NUE_OEX_1 | YNL147W | S. cerevisiae | 16133 | Cytoplasmic | 16135, 16137, 16139, 16141, 16143, 16145, 16147, 16149, 16151, 16153, 16155, 16157, 16159, 16161, 16163, 16165, 16167, 16169, 16171, 16173, 16175, 16177, 16179, 16181, 16183, 16185, 16187, 16189, 16191, 16193, 16195, 16197, 16199, 16201, 16203, 16205, 16207, 16209, 16211, 16213, 16215, 16217, 16219, 16221, 16223, 16225, 16227, 16229, 16231, 16233, 16235, 16237, 16239, 16241, 16243, 16245, 16247, 16249, 16251, 16253, 16255 |
| 1 | 178 | NUE_OEX_1 | YBR083W | S. cerevisiae | 15056 | Cytoplasmic | 15058, 15060 |
| 1 | 179 | NUE_OEX_1 | YKL111C | S. cerevisiae | 15587 | Cytoplasmic | 15589 |
| 1 | 180 | NUE_OEX_1 | YPR067W | S. cerevisiae | 16582 | Cytoplasmic | 16584, 16586, 16588, 16590, 16592, 16594, 16596, 16598, 16600, 16602, 16604, 16606, 16608, 16610, 16612, 16614, 16616, 16618, 16620, 16622 |
| 1 | 181 | NUE_OEX_1 | B1985 | E. coli | 14839 | Cytoplasmic | 14841, 14843, 14845, 14847, 14849, 14851, 14853, 14855, 14857, 14859, 14861, 14863, 14865 |
| 1 | 182 | NUE_OEX_1 | B3838 | E. coli | 15014 | Cytoplasmic | 15016, 15018, 15020, 15022, 15024, 15026, 15028, 15030, 15032, 15034, 15036, 15038, 15040, 15042, 15044, 15046, 15048 |
| 1 | 183 | NUE_OEX_1 | YJL010C | S. cerevisiae | 15432 | Cytoplasmic | 15434, 15436, 15438, 15440, 15442, 15444, 15446, 15448 |
| 1 | 184 | NUE_OEX_1 | B1267 | E. coli | 14497 | Cytoplasmic | 14499, 14501, 14503, 14505, 14507, 14509, 14511, 14513, 14515, 14517, 14519, 14521, 14523, 14525, 14527, 14529, 14531, 14533, 14535, 14537, 14539, 14541, 14543, 14545, 14547, 14549, 14551, 14553, 14555, 14557, 14559, 14561, 14563, 14565, 14567, 14569, 14571, 14573, 14575, 14577, 14579, 14581, 14583, 14585, 14587, 14589, 14591, 14593, 14595, 14597, 14599, 14601, 14603, 14605, 14607, 14609, 14611, 14613, 14615, 14617, 14619, 14621, 14623, 14625, 14627, 14629, 14631, 14633, 14635, 14637, 14639, 14641, 14643, 14645, 14647, 14649, 14651, 14653, 14655, 14657, 14659, 14661, 14663, 14665, 14667, 14669, 14671, 14673, 14675, 14677, 14679, 14681, 14683, 14685, 14687, 14689, 14691, 14693, 14695, 14697, 14699, 14701, 14703, 14705, 14707 |
| 1 | 185 | NUE_OEX_1 | B1322 | E. coli | 14718 | Cytoplasmic | 14720, 14722, 14724, 14726, 14728, 14730, 14732, 14734, 14736, 14738, 14740, 14742, 14744, 14746, 14748, 14750, 14752, 14754, 14756, 14758, 14760, 14762, 14764, 14766, 14768, 14770, 14772, 14774, 14776, 14778, 14780, 14782, 14784 |
| 1 | 186 | NUE_OEX_1 | B1381 | E. coli | 14791 | Cytoplasmic | 14793, 14795, 14797, 14799, 14801, 14803, 14805, 14807, 14809, 14811, 14813, 14815, 14817, 14819 |
| 1 | 187 | NUE_OEX_1 | B2646 | E. coli | 14879 | Cytoplasmic | 14881, 14883, 14885, 14887, 14889, 14891, 14893, 14895, 14897, 14899, 14901, 14903, 14905, 14907 |
| 1 | 188 | NUE_OEX_1 | YBR191W | S. cerevisiae | 15064 | Cytoplasmic | 15066, 15068, 15070, 15072, 15074, 15076, 15078, 15080, 15082, 15084, 15086, 15088, 15090, 15092, 15094, 15096, 15098, 15100, 15102, 15104, 15106, 15108, 15110, 15112, 15114, 15116, 15118, 15120, 15122, 15124, 15126, 15128, 15130, 15132, 15134, 15136, 15138, 15140, 15142, 15144, 15146, 15148, 15150, 15152, 15154, 15156, 15158, 15160, 15162, 15164, 15166, 15168, 15170, 15172, 15174, 15176, 15178, 15180, 15182, 15184, 15186, 15188, 15190, 15192, 15194, 15196, 15198, 15200, 15202, 15204, 15206, 15208, 15210, 15212, 15214, 15216 |
| 1 | 189 | NUE_OEX_1 | YDL135C | S. cerevisiae | 15257 | Cytoplasmic | 15259, 15261, 15263, 15265, 15267, 15269, 15271, 15273, 15275, 15277, 15279, 15281, 15283, 15285, 15287, 15289, 15291, 15293, 15295, 15297, 15299, 15301, 15303, 15305, 15307, 15309, 15311, 15313, 15315, 15317, 15319, 15321, 15323, 15325, 15327, 15329, 15331, 15333, 15335, 15337, 15339, 15341, 15343, 15345, 15347, 15349, 15351, 15353, 15355 |
| 1 | 190 | NUE_OEX_1 | YHL005C | S. cerevisiae | 15378 | Cytoplasmic | — |
| 1 | 191 | NUE_OEX_1 | YKR100C_2 | S. cerevisiae | 16629 | Cytoplasmic | 16631, 16633, 16635, 16637 |
| 1 | 192 | NUE_OEX_1 | YMR191W_2 | S. cerevisiae | 16647 | Cytoplasmic | 16649, 16651 |

TABLE IA_CHOM

| | | | | | | | |
|---|---|---|---|---|---|---|---|
| | | | | | | | Nucleic acid sequence ID numbers |
| Application | 1. Hit | 2. Project | 3. Locus | 4. Organism | 5. Lead SEQ ID | 6. Target | 7. SEQ IDs of Nucleic Acid Homologs |
| 1 | 1 | NUE_OEX_1 | yor128c CHOM | S. cerevisiae | 13030 | Cytoplasmic | 13117, 13119, 13121, 13123, 13125, 13127, 13129, 13131, 13133, 13135, 13137, 13139, 13141, 13143, 13145, 13147, 13149, 13151, 13153, 13155, 13157, 13159, 13161, 13163, 13165, 13167, 13169, 13171, 13173, 13175, 13177, 13179, 13181, 13183, 13185, 13187, 13189, 13191, 13193, 13195, 13197, 13199, 13201, 13203, 13205, 13207, 13209, 13211, 13213, 13215, 13217, 13219, 13221, 13223, 13225, 13227, 13229, 13231, 13233, 13235, 13237, 13239, 13241, 13243, 13245, 13247, 13249, 13251, 13253, 13255, 13257, 13259, 13261, 13263, 13265, 13267, 13269, 13271, 13273, 13275, 13277, 13279, 13281, 13283, 13285, 13287, 13289, 13291, 13293, 13295, 13297, 13299, 13301, 13303, 13305, 13307, 13309, 13311, 13313, 13315, 13317, 13319, 13321, 13323, 13325, 13327, 13329, 13331, 13333, 13335, 13337, 13339, 13341, 13343, 13345, 13347, 13349, 13351, 13353, 13355, 13357, 13359, 13361, 13363, 13365, 13367, 13369, 13371, 13373, 13375, 13377, 13379, 13381, 13383, 13385, 13387, 13389, 13391, 13393, 13395, 13397, 13399, 13401, 13403, 13405, 13407, 13409, 13411, 13413, 13415, 13417, 13419, 13421, 13423, 13425, 13427, 13429, 13431, 13433, 13435, 13437, 13439, 13441, 13443, 13445, 13447, 13449, 13451, 13453, 13455, 13457, 13459, 13461, 13463, 13465, 13467, 13469, 13471, 13473, 13475, 13477, 13479, 13481, 13483, 13485, 13487, 13489, 13491, 13493, 13495, 13497, 13499, 13501, 13503, 13505, 13507, 13509, 13511, 13513, 13515, 13517, 13519, 13521, 13523, 13525, 13527, 13529, 13531, 13533, 13535, 13537, 13539, 13541, 13543, 13545, 13547, 13549, 13551, 13553, 13555, 13557, 13559, 13561, 13563, 13565, 13567, 13569, 13571, 13573, 13575, 13577, 13579, 13581, 13583, 13585, 13587, 13589, 13591, 13593, 13595, 13597, 13599, 13601, 13603, 13605, 13607, 13609, 13611, 13613, 13615 |

TABLE IA_NHOM

| | | | | | | | |
|---|---|---|---|---|---|---|---|
| | | | | | | | Nucleic acid sequence ID numbers |
| Application | 1. Hit | 2. Project | 3. Locus | 4. Organism | 5. Lead SEQ ID | 6. Target | 7. SEQ IDs of Nucleic Acid Homologs |
| 1 | 1 | NUE_OEX_1 | yor128c NHOM | S. cerevisiae | 13030 | Cytoplasmic | 13624, 13626, 13628, 13630, 13632, 13634, 13636, 13638, 13640, 13642, 13644, 13646, 13648, 13650, 13652, 13654, 13656, 13658, 13660, 13662, 13664, 13666, 13668, 13670, 13672, 13674, 13676, 13678, 13680, 13682, 13684, 13686, 13688, 13690, 13692, 13694, 13696, 13698, 13700, 13702, 13704, 13706, 13708, 13710, 13712, 13714, 13716, 13718, 13720, 13722, 13724, 13726, 13728, 13730, 13732, 13734, 13736, 13738, 13740, 13742, 13744, 13746, 13748, 13750, 13752, 13754, 13756, 13758, 13760, 13762, 13764, 13766, 13768, 13770, 13772, 13774, 13776, 13778, 13780, 13782, 13784, 13786, 13788, 13790, 13792, 13794, 13796, 13798, 13800, 13802, 13804, 13806, 13808, 13810, 13812, 13814, 13816, 13818, 13820, 13822, 13824, 13826, 13828, 13830, 13832, 13834, 13836, 13838, 13840, 13842, 13844, 13846, 13848, 13850, 13852, 13854, 13856, 13858, 13860, 13862, 13864, 13866, 13868, 13870, 13872, 13874, 13876, 13878, 13880, 13882, 13884, 13886, 13888, 13890, 13892, 13894, 13896, 13898, 13900, 13902, 13904, 13906, 13908, 13910, 13912, 13914, 13916, 13918, 13920, 13922, 13924, 13926, 13928, 13930, 13932, 13934, 13936, 13938, 13940, 13942, 13944, 13946, 13948, 13950, 13952, 13954, 13956, 13958, 13960, 13962, 13964, 13966, 13968, 13970, 13972, 13974, 13976, 13978, 13980, 13982, 13984, 13986, 13988, 13990, 13992, 13994, 13996, 13998, 14000, 14002, 14004, 14006, 14008, 14010, 14012, 14014, 14016, 14018, 14020, 14022, 14024, 14026, 14028, 14030, 14032, 14034, 14036, 14038, 14040, 14042, 14044, 14046, 14048, 14050, 14052, 14054, 14056, 14058, 14060, 14062, 14064, 14066, 14068, 14070, 14072, 14074, 14076, 14078, 14080 |

TABLE IB

| | | | | | 5. | | |
|---|---|---|---|---|---|---|---|
| Appli-cation | 1. Hit | 2. Project | 3. Locus | 4. Organism | Lead SEQ ID | 6. Target | 7. SEQ IDs of Nucleic Acid Homologs |
| 1 | 1 | NUE_OEX_1 | B0017 | *E. coli* | 38 | Cytoplasmic | — |
| 1 | 2 | NUE_OEX_1 | B0045 | *E. coli* | 42 | Cytoplasmic | 98, 100, 102, 104, 106, 108, 110, 112, 114, 116 |
| 1 | 3 | NUE_OEX_1 | B0180 | *E. coli* | 123 | Plastidic | 365, 367, 369, 371, 373 |
| 1 | 4 | NUE_OEX_1 | B0242 | *E. coli* | 380 | Plastidic | 662, 664, 666, 668 |
| 1 | 5 | NUE_OEX_1 | B0403 | *E. coli* | 679 | Plastidic | — |
| 1 | 6 | NUE_OEX_1 | B0474 | *E. coli* | 812 | Cytoplasmic | 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 16657 |
| 1 | 7 | NUE_OEX_1 | B0754 | *E. coli* | 1055 | Plastidic | — |
| 1 | 8 | NUE_OEX_1 | B0784 | *E. coli* | 1563 | Cytoplasmic | — |
| 1 | 9 | NUE_OEX_1 | B0873 | *E. coli* | 1705 | Plastidic | — |
| 1 | 10 | NUE_OEX_1 | B1014 | *E. coli* | 1844 | Cytoplasmic | — |
| 1 | 11 | NUE_OEX_1 | B1020 | *E. coli* | 1950 | Plastidic | — |
| 1 | 12 | NUE_OEX_1 | B1180 | *E. coli* | 1975 | Cytoplasmic | 2099, 2101, 2103, 2105, 2107, 2109, 2111, 2113, 2115, 2117, 2119, 16661 |
| 1 | 13 | NUE_OEX_1 | B1933 | *E. coli* | 2127 | Plastidic | — |
| 1 | 14 | NUE_OEX_1 | B2032 | *E. coli* | 2135 | Plastidic | — |
| 1 | 15 | NUE_OEX_1 | B2165 | *E. coli* | 2171 | Plastidic | 2285, 2287 |
| 1 | 16 | NUE_OEX_1 | B2223 | *E. coli* | 2297 | Plastidic | — |
| 1 | 17 | NUE_OEX_1 | B2238 | *E. coli* | 2426 | Plastidic | — |
| 1 | 17 | NUE_OEX_1 | B2238 | *E. coli* | 2426 | Cytoplasmic | — |
| 1 | 18 | NUE_OEX_1 | B2310 | *E. coli* | 2452 | Plastidic | — |
| 1 | 19 | NUE_OEX_1 | B2431 | *E. coli* | 2551 | Plastidic | — |
| 1 | 20 | NUE_OEX_1 | B2600 | *E. coli* | 2600 | Plastidic | — |
| 1 | 21 | NUE_OEX_1 | B2766 | *E. coli* | 2668 | Plastidic | — |
| 1 | 22 | NUE_OEX_1 | B2903 | *E. coli* | 2772 | Cytoplasmic | 3096, 3098 |
| 1 | 23 | NUE_OEX_1 | B3117 | *E. coli* | 3117 | Plastidic | 3373, 3375, 3377, 3379, 3381 |
| 1 | 24 | NUE_OEX_1 | B3120 | *E. coli* | 3390 | Plastidic | — |
| 1 | 25 | NUE_OEX_1 | B3216 | *E. coli* | 3396 | Plastidic | — |
| 1 | 26 | NUE_OEX_1 | B3451 | *E. coli* | 3470 | Plastidic | — |
| 1 | 27 | NUE_OEX_1 | B3791 | *E. coli* | 3563 | Cytoplasmic | — |
| 1 | 28 | NUE_OEX_1 | B3825 | *E. coli* | 3770* | Plastidic | — |
| 1 | 29 | NUE_OEX_1 | YAL019W | *S. cerevisiae* | 3868 | Cytoplasmic | — |
| 1 | 30 | NUE_OEX_1 | YAR035W | *S. cerevisiae* | 3895 | Cytoplasmic | — |
| 1 | 31 | NUE_OEX_1 | YBL021C | *S. cerevisiae* | 3953 | Cytoplasmic | 4031, 4033, 4035, 4037, 4039, 4041, 4043, 4045, 4047, 4049, 4051, 4053, 4055, 4057, 4059, 4061, 4063, 4065, 4067, 4069, 4071, 4073, 4075, 4077, 4079, 4081, 4083, 4085, 4087, 4089, 4091, 4093, 4095, 4097, 4099, 4101, 4103, 4105 |
| 1 | 32 | NUE_OEX_1 | YBR055C | *S. cerevisiae* | 4111 | Cytoplasmic | — |
| 1 | 33 | NUE_OEX_1 | YBR128C | *S. cerevisiae* | 4149 | Cytoplasmic | — |
| 1 | 34 | NUE_OEX_1 | YBR159W | *S. cerevisiae* | 4162 | Cytoplasmic | 4214, 4216, 4218, 4220, 4222, 4224, 4226 |
| 1 | 35 | NUE_OEX_1 | YBR243C | *S. cerevisiae* | 4235 | Cytoplasmic | 4267, 4269 |
| 1 | 35 | NUE_OEX_1 | YBR243C | *S. cerevisiae* | 4235 | Plastidic | 4267, 4269 |
| 1 | 36 | NUE_OEX_1 | YBR262C | *S. cerevisiae* | 4280 | Cytoplasmic | — |
| 1 | 37 | NUE_OEX_1 | YCR019W | *S. cerevisiae* | 4288 | Cytoplasmic | — |
| 1 | 38 | NUE_OEX_1 | YDR070C | *S. cerevisiae* | 4315 | Cytoplasmic | — |
| 1 | 39 | NUE_OEX_1 | YDR079W | *S. cerevisiae* | 4325 | Cytoplasmic | — |
| 1 | 40 | NUE_OEX_1 | YDR123C | *S. cerevisiae* | 4335 | Cytoplasmic | — |
| 1 | 41 | NUE_OEX_1 | YDR137W | *S. cerevisiae* | 4346 | Cytoplasmic | — |
| 1 | 42 | NUE_OEX_1 | YDR294C | *S. cerevisiae* | 4361 | Cytoplasmic | — |
| 1 | 42 | NUE_OEX_1 | YDR294C | *S. cerevisiae* | 4361 | Plastidic | — |
| 1 | 43 | NUE_OEX_1 | YDR330W | *S. cerevisiae* | 4402 | Cytoplasmic | — |
| 1 | 44 | NUE_OEX_1 | YDR355C | *S. cerevisiae* | 4431 | Cytoplasmic | — |
| 1 | 45 | NUE_OEX_1 | YDR430C | *S. cerevisiae* | 4435 | Plastidic | — |
| 1 | 46 | NUE_OEX_1 | YDR472W | *S. cerevisiae* | 4485 | Cytoplasmic | — |
| 1 | 47 | NUE_OEX_1 | YDR497C | *S. cerevisiae* | 4506 | Plastidic | 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 16665 |
| 1 | 48 | NUE_OEX_1 | YER029C | *S. cerevisiae* | 4790 | Cytoplasmic | — |
| 1 | 49 | NUE_OEX_1 | YFR007W | *S. cerevisiae* | 4806 | Cytoplasmic | — |
| 1 | 50 | NUE_OEX_1 | YGL039W | *S. cerevisiae* | 4836 | Cytoplasmic | 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, 5260, 5262, 5264, 5266, 5268, 5270, 5272, 5274, 5276, 5278, 5280, 5282, 5284, 5286, 5288, 5290, 5292, 5294, 5296, 5298, 5300, 5302, 5304 |
| 1 | 51 | NUE_OEX_1 | YGL043W | *S. cerevisiae* | 5311 | Cytoplasmic | 5335, 5337, 5339 |
| 1 | 52 | NUE_OEX_1 | YGR088W | *S. cerevisiae* | 5346 | Cytoplasmic | 5524 |
| 1 | 53 | NUE_OEX_1 | YGR122C-A | *S. cerevisiae* | 5533 | Cytoplasmic | — |
| 1 | 54 | NUE_OEX_1 | YGR142W | *S. cerevisiae* | 5551 | Cytoplasmic | — |

TABLE IB-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 55 | NUE_OEX_1 | YGR143W | S. cerevisiae | 5559 | Cytoplasmic | — |
| 1 | 56 | NUE_OEX_1 | YGR165W | S. cerevisiae | 5602 | Cytoplasmic | — |
| 1 | 57 | NUE_OEX_1 | YGR170W | S. cerevisiae | 5608 | Cytoplasmic | — |
| 1 | 58 | NUE_OEX_1 | YGR202C | S. cerevisiae | 5614 | Cytoplasmic | — |
| 1 | 59 | NUE_OEX_1 | YGR266W | S. cerevisiae | 5666 | Cytoplasmic | — |
| 1 | 60 | NUE_OEX_1 | YGR282C | S. cerevisiae | 5701 | Cytoplasmic | — |
| 1 | 61 | NUE_OEX_1 | YGR290W | S. cerevisiae | 5750 | Cytoplasmic | — |
| 1 | 62 | NUE_OEX_1 | YHL021C | S. cerevisiae | 5754 | Cytoplasmic | — |
| 1 | 63 | NUE_OEX_1 | YHL031C | S. cerevisiae | 5778 | Cytoplasmic | — |
| 1 | 64 | NUE_OEX_1 | YHR011W | S. cerevisiae | 5812 | Cytoplasmic | 5954, 5956, 5958, 16669 |
| 1 | 65 | NUE_OEX_1 | YHR127W | S. cerevisiae | 5967 | Cytoplasmic | — |
| 1 | 66 | NUE_OEX_1 | YHR137W | S. cerevisiae | 5973 | Cytoplasmic | — |
| 1 | 66 | NUE_OEX_1 | YHR137W | S. cerevisiae | 5973 | Plastidic | — |
| 1 | 67 | NUE_OEX_1 | YIL099W | S. cerevisiae | 6027 | Cytoplasmic | — |
| 1 | 67 | NUE_OEX_1 | YIL099W | S. cerevisiae | 6027 | Plastidic | — |
| 1 | 68 | NUE_OEX_1 | YIL147C | S. cerevisiae | 6107 | Cytoplasmic | — |
| 1 | 69 | NUE_OEX_1 | YIR034C | S. cerevisiae | 6150* | Cytoplasmic | — |
| 1 | 70 | NUE_OEX_1 | YJL013C | S. cerevisiae | 6198 | Cytoplasmic | — |
| 1 | 71 | NUE_OEX_1 | YJL041W | S. cerevisiae | 6208 | Cytoplasmic | — |
| 1 | 72 | NUE_OEX_1 | YJL064W | S. cerevisiae | 6242 | Cytoplasmic | — |
| 1 | 73 | NUE_OEX_1 | YJL067W | S. cerevisiae | 6246 | Cytoplasmic | — |
| 1 | 74 | NUE_OEX_1 | YJL094C | S. cerevisiae | 6250 | Cytoplasmic | — |
| 1 | 75 | NUE_OEX_1 | YJL171C | S. cerevisiae | 6297 | Cytoplasmic | — |
| 1 | 76 | NUE_OEX_1 | YJL213W | S. cerevisiae | 6326 | Cytoplasmic | — |
| 1 | 77 | NUE_OEX_1 | YJR017C | S. cerevisiae | 6488 | Cytoplasmic | 6542 |
| 1 | 78 | NUE_OEX_1 | YJR058C | S. cerevisiae | 6550 | Cytoplasmic | 6662, 6664, 6666, 6668, 6670, 6672, 6674, 6676, 6678, 6680, 6682, 6684, 6686, 6688, 6690, 6692, 6694, 16673, 16675 |
| 1 | 79 | NUE_OEX_1 | YJR117W | S. cerevisiae | 6700 | Cytoplasmic | 6790, 6792, 6794, 6796, 6798, 6800, 6802, 6804, 6806 |
| 1 | 80 | NUE_OEX_1 | YJR121W | S. cerevisiae | 6816 | Cytoplasmic | 7336, 7338, 7340, 7342, 7344, 7346, 7348 |
| 1 | 81 | NUE_OEX_1 | YJR131W | S. cerevisiae | 7366* | Cytoplasmic | 7460, 7462, 7464, 7466 |
| 1 | 82 | NUE_OEX_1 | YJR145C | S. cerevisiae | 7475 | Cytoplasmic | 7559, 7561, 7563, 7565, 7567, 7569, 7571, 7573, 7575, 7577, 7579, 7581, 7583, 7585, 7587, 7589, 7591, 7593, 7595, 16679 |
| 1 | 83 | NUE_OEX_1 | YKL084W | S. cerevisiae | 7602 | Cytoplasmic | — |
| 1 | 84 | NUE_OEX_1 | YKL088W | S. cerevisiae | 7651 | Cytoplasmic | — |
| 1 | 85 | NUE_OEX_1 | YKL100C | S. cerevisiae | 7661* | Cytoplasmic | — |
| 1 | 86 | NUE_OEX_1 | YKL131W | S. cerevisiae | 7675 | Cytoplasmic | — |
| 1 | 87 | NUE_OEX_1 | YKL138C | S. cerevisiae | 7679 | Cytoplasmic | — |
| 1 | 88 | NUE_OEX_1 | YKL178C | S. cerevisiae | 7710 | Cytoplasmic | — |
| 1 | 89 | NUE_OEX_1 | YKL179C | S. cerevisiae | 7735 | Cytoplasmic | — |
| 1 | 90 | NUE_OEX_1 | YKL193C | S. cerevisiae | 7778* | Cytoplasmic | 7814, 7816, 7818, 7820 |
| 1 | 91 | NUE_OEX_1 | YKL216W | S. cerevisiae | 7829 | Cytoplasmic | — |
| 1 | 92 | NUE_OEX_1 | YKR016W | S. cerevisiae | 8017 | Cytoplasmic | — |
| 1 | 93 | NUE_OEX_1 | YKR021W | S. cerevisiae | 8045 | Cytoplasmic | — |
| 1 | 94 | NUE_OEX_1 | YKR055W | S. cerevisiae | 8073 | Cytoplasmic | 8257 |
| 1 | 95 | NUE_OEX_1 | YKR088C | S. cerevisiae | 8263 | Plastidic | — |
| 1 | 96 | NUE_OEX_1 | YKR093W | S. cerevisiae | 8287 | Cytoplasmic | 8443, 8445, 8447, 8449, 8451, 8453, 8455, 8457, 8459, 8461 |
| 1 | 97 | NUE_OEX_1 | YKR099W | S. cerevisiae | 8468 | Cytoplasmic | — |
| 1 | 98 | NUE_OEX_1 | YKR100C | S. cerevisiae | 8484 | Cytoplasmic | — |
| 1 | 99 | NUE_OEX_1 | YLL014W | S. cerevisiae | 8492 | Cytoplasmic | — |
| 1 | 100 | NUE_OEX_1 | YLL016W | S. cerevisiae | 8514* | Cytoplasmic | — |
| 1 | 101 | NUE_OEX_1 | YLL023C | S. cerevisiae | 8539 | Cytoplasmic | — |
| 1 | 102 | NUE_OEX_1 | YLL037W | S. cerevisiae | 8571 | Cytoplasmic | — |
| 1 | 103 | NUE_OEX_1 | YLL049W | S. cerevisiae | 8575 | Cytoplasmic | — |
| 1 | 104 | NUE_OEX_1 | YLL055W | S. cerevisiae | 8579 | Cytoplasmic | — |
| 1 | 105 | NUE_OEX_1 | YLR034C | S. cerevisiae | 8661* | Cytoplasmic | 8963, 8965, 8967, 8969, 8971, 8973, 8975, 8977, 8979, 8981 |
| 1 | 106 | NUE_OEX_1 | YLR042C | S. cerevisiae | 8991 | Cytoplasmic | — |
| 1 | 107 | NUE_OEX_1 | YLR053C | S. cerevisiae | 8995 | Cytoplasmic | — |
| 1 | 108 | NUE_OEX_1 | YLR058C | S. cerevisiae | 8999 | Cytoplasmic | 9501, 9503, 9505, 9507, 9509, 9511, 9513, 9515, 9517, 9519, 9521, 9523, 9525, 9527, 9529, 9531, 9533, 9535, 9537, 9539 |
| 1 | 109 | NUE_OEX_1 | YLR060W | S. cerevisiae | 9551* | Cytoplasmic | — |
| 1 | 110 | NUE_OEX_1 | YLR065C | S. cerevisiae | 9637 | Cytoplasmic | — |
| 1 | 111 | NUE_OEX_1 | YLR070C | S. cerevisiae | 9672 | Cytoplasmic | 10118, 10120, 10122, 10124, 10126, 10128, 10130, 10132, 10134, 10136, 10138, 10140, 10142, 10144, 10146, 10148, 10150, 10152, 10154, 10156, 10158, 10160, 10162, 10164, 10166, 10168, 10170, 10172, 10174, 10176 |
| 1 | 112 | NUE_OEX_1 | YLR100W | S. cerevisiae | 10182 | Cytoplasmic | — |
| 1 | 113 | NUE_OEX_1 | YLR109W | S. cerevisiae | 10214 | Cytoplasmic | 10418, 10420, 10422, 10424, 10426, 10428, 10430, 10432, 10434, 10436, 10438, 10440, 10442 |
| 1 | 114 | NUE_OEX_1 | YLR125W | S. cerevisiae | 10447 | Cytoplasmic | — |
| 1 | 115 | NUE_OEX_1 | YLR127C | S. cerevisiae | 10451 | Cytoplasmic | — |
| 1 | 116 | NUE_OEX_1 | YLR185W | S. cerevisiae | 10463 | Cytoplasmic | 10513, 10515, 10517, 10519, 10521, 10523, 10525 |
| 1 | 117 | NUE_OEX_1 | YLR204W | S. cerevisiae | 10533 | Cytoplasmic | — |
| 1 | 117 | NUE_OEX_1 | YLR204W | S. cerevisiae | 10533 | Plastidic | — |

TABLE IB-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 118 | NUE_OEX_1 | YLR242C | S. cerevisiae | 10541 | Cytoplasmic | — |
| 1 | 119 | NUE_OEX_1 | YLR293C | S. cerevisiae | 10562 | Cytoplasmic | 10714, 10716, 10718, 10720, 10722, 10724, 10726, 10728, 10730, 10732, 10734, 10736, 10738, 10740, 10742, 10744, 10746, 10748, 10750, 10752, 10754, 10756, 10758, 10760, 10762, 10764, 10766, 10768, 10770, 10772, 10774, 10776, 10778, 10780, 10782, 10784, 10786, 10788, 10790, 10792, 10794, 10796, 10798, 10800, 10802, 10804, 10806, 10808, 10810, 10812, 10814, 10816, 10818, 10820, 10822, 10824, 10826, 10828, 10830, 10832, 10834, 10836, 10838, 10840, 10842, 10844, 10846, 10848, 10850, 10852, 10854, 10856, 10858, 10860, 10862, 10864, 10866, 10868, 10870, 10872, 10874, 10876, 10878, 10880, 10882, 10884, 10886, 10888, 10890, 10892, 10894, 10896, 10898, 10900, 10902, 10904, 10906, 10908, 10910, 10912, 10914, 10916, 10918, 10920, 10922, 10924, 10926, 10928, 10930, 10932, 10934, 10936, 10938, 10940, 10942, 10944, 10946, 10948, 10950, 10952, 10954, 10956, 10958, 10960, 10962, 10964, 10966, 10968, 10970, 10972, 10974, 10976, 10978, 10980, 10982 |
| 1 | 120 | NUE_OEX_1 | YLR313C | S. cerevisiae | 10990 | Cytoplasmic | — |
| 1 | 121 | NUE_OEX_1 | YLR315W | S. cerevisiae | 10998 | Cytoplasmic | — |
| 1 | 122 | NUE_OEX_1 | YLR329W | S. cerevisiae | 11004 | Cytoplasmic | — |
| 1 | 123 | NUE_OEX_1 | YLR362W | S. cerevisiae | 11012 | Cytoplasmic | — |
| 1 | 124 | NUE_OEX_1 | YLR395C | S. cerevisiae | 11054 | Cytoplasmic | — |
| 1 | 125 | NUE_OEX_1 | YLR404W | S. cerevisiae | 11066 | Cytoplasmic | — |
| 1 | 126 | NUE_OEX_1 | YLR463C | S. cerevisiae | 11074 | Cytoplasmic | — |
| 1 | 127 | NUE_OEX_1 | YML022W | S. cerevisiae | 11080 | Cytoplasmic | 11526, 11528, 11530, 11532, 11534, 11536, 11538, 11540, 11542, 11544, 11546 |
| 1 | 128 | NUE_OEX_1 | YML027W | S. cerevisiae | 11552 | Cytoplasmic | — |
| 1 | 129 | NUE_OEX_1 | YML065W | S. cerevisiae | 11569 | Cytoplasmic | — |
| 1 | 130 | NUE_OEX_1 | YML089C | S. cerevisiae | 11596 | Cytoplasmic | — |
| 1 | 131 | NUE_OEX_1 | YML128C | S. cerevisiae | 11600 | Cytoplasmic | — |
| 1 | 132 | NUE_OEX_1 | YMR011W | S. cerevisiae | 11612 | Cytoplasmic | 12124, 12126, 12128, 12130, 12132, 12134, 12136, 12138, 12140, 12142, 12144, 12146, 12148, 12150, 12152, 12154, 12156, 12158, 12160, 12162, 12164, 12166, 12168, 12170, 12172, 12174, 12176, 12178, 12180, 12182, 12184, 12186, 12188, 12190, 12192, 12194, 12196, 12198, 12200, 12202, 12204, 12206, 12208, 12210, 12212, 12214, 12216, 12218, 12220, 12222, 12224, 12226, 12228, 12230, 12232, 12234, 12236, 12238, 12240 |
| 1 | 133 | NUE_OEX_1 | YMR037C | S. cerevisiae | 12246 | Cytoplasmic | — |
| 1 | 134 | NUE_OEX_1 | YMR049C | S. cerevisiae | 12263 | Cytoplasmic | — |
| 1 | 135 | NUE_OEX_1 | YMR052W | S. cerevisiae | 12316 | Cytoplasmic | — |
| 1 | 136 | NUE_OEX_1 | YMR082C | S. cerevisiae | 12327* | Cytoplasmic | — |
| 1 | 137 | NUE_OEX_1 | YMR125W | S. cerevisiae | 12331 | Cytoplasmic | — |
| 1 | 138 | NUE_OEX_1 | YMR126C | S. cerevisiae | 12378 | Cytoplasmic | — |
| 1 | 139 | NUE_OEX_1 | YMR144W | S. cerevisiae | 12394 | Cytoplasmic | — |
| 1 | 140 | NUE_OEX_1 | YMR160W | S. cerevisiae | 12406 | Cytoplasmic | — |
| 1 | 141 | NUE_OEX_1 | YMR191W | S. cerevisiae | 12414 | Cytoplasmic | — |
| 1 | 142 | NUE_OEX_1 | YMR209C | S. cerevisiae | 12420 | Cytoplasmic | — |
| 1 | 143 | NUE_OEX_1 | YMR233W | S. cerevisiae | 12440 | Cytoplasmic | — |
| 1 | 144 | NUE_OEX_1 | YMR278W | S. cerevisiae | 12470 | Cytoplasmic | — |
| 1 | 145 | NUE_OEX_1 | YMR280C | S. cerevisiae | 12749 | Cytoplasmic | — |
| 1 | 146 | NUE_OEX_1 | YNL014W | S. cerevisiae | 12773 | Cytoplasmic | — |
| 1 | 147 | NUE_OEX_1 | YNL320W | S. cerevisiae | 12829 | Cytoplasmic | 12867, 12869, 12871, 12873 |
| 1 | 148 | NUE_OEX_1 | YOL007C | S. cerevisiae | 12883 | Cytoplasmic | — |
| 1 | 149 | NUE_OEX_1 | YOL164W | S. cerevisiae | 12889 | Cytoplasmic | — |
| 1 | 150 | NUE_OEX_1 | YOR076C | S. cerevisiae | 13014 | Cytoplasmic | — |
| 1 | 151 | NUE_OEX_1 | YOR083W | S. cerevisiae | 13018 | Cytoplasmic | — |
| 1 | 152 | NUE_OEX_1 | YOR097C | S. cerevisiae | 13024 | Cytoplasmic | — |
| 1 | 153 | NUE_OEX_1 | YOR128C | S. cerevisiae | 13030 | Cytoplasmic | 13098 |
| 1 | 154 | NUE_OEX_1 | YOR353C | S. cerevisiae | 14085 | Cytoplasmic | — |
| 1 | 155 | NUE_OEX_1 | YPL141C | S. cerevisiae | 14093 | Cytoplasmic | — |
| 1 | 156 | NUE_OEX_1 | YPR088C | S. cerevisiae | 14113 | Cytoplasmic | 14215, 14217, 14219, 14221, 14223, 14225, 14227, 14229, 14231, 14233 |
| 1 | 157 | NUE_OEX_1 | YPR108W | S. cerevisiae | 14246 | Cytoplasmic | 14290, 14292, 14294, 14296, 14298 |
| 1 | 158 | NUE_OEX_1 | YPR110C | S. cerevisiae | 14311 | Cytoplasmic | 14373, 14375, 14377, 14379, 14381 |
| 1 | 159 | NUE_OEX_1 | B3825_2 | E. coli | 14914 | Plastidic | — |
| 1 | 160 | NUE_OEX_1 | YIR034C_2 | S. cerevisiae | 15382 | Cytoplasmic | — |
| 1 | 161 | NUE_OEX_1 | YJR131W_2 | S. cerevisiae | 15460 | Cytoplasmic | 15556, 15558, 15560, 15562 |
| 1 | 162 | NUE_OEX_1 | YKL100C_2 | S. cerevisiae | 15571 | Cytoplasmic | — |
| 1 | 163 | NUE_OEX_1 | YKL193C_2 | S. cerevisiae | 15593 | Cytoplasmic | 15631, 15633, 15635, 15637 |
| 1 | 164 | NUE_OEX_1 | YLL016W_2 | S. cerevisiae | 15646 | Cytoplasmic | — |
| 1 | 165 | NUE_OEX_1 | YLR034C_2 | S. cerevisiae | 15673 | Cytoplasmic | 15977, 15979, 15981, 15983, 15985, 15987, 15989, 15991, 15993, 15995 |

TABLE IB-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 166 | NUE_OEX_1 | YLR060W_2 | S. cerevisiae | 16005 | Cytoplasmic | — |
| 1 | 167 | NUE_OEX_1 | YMR082C_2 | S. cerevisiae | 16114 | Cytoplasmic | — |
| 1 | 168 | NUE_OEX_1 | B1258 | E. coli | 14402 | Cytoplasmic | — |
| 1 | 169 | NUE_OEX_1 | YML101C | S. cerevisiae | 16093 | Cytoplasmic | — |
| 1 | 170 | NUE_OEX_1 | YMR065W | S. cerevisiae | 16106 | Cytoplasmic | — |
| 1 | 171 | NUE_OEX_1 | YMR163C | S. cerevisiae | 16120 | Cytoplasmic | — |
| 1 | 172 | NUE_OEX_1 | YOL042W | S. cerevisiae | 16275 | Cytoplasmic | — |
| 1 | 173 | NUE_OEX_1 | YOR226C | S. cerevisiae | 16305 | Cytoplasmic | 16537, 16539, 16541, 16543, 16545, 16547, 16549, 16551, 16553, 16555, 16557, 16559, 16561, 16563, 16565 |
| 1 | 174 | NUE_OEX_1 | YPL068C | S. cerevisiae | 16573 | Cytoplasmic | — |
| 1 | 175 | NUE_OEX_1 | B0165 | E. coli | 14396 | Plastidic | — |
| 1 | 176 | NUE_OEX_1 | YOR203W | S. cerevisiae | 16299 | Cytoplasmic | — |
| 1 | 177 | NUE_OEX_1 | YNL147W | S. cerevisiae | 16133 | Cytoplasmic | 16257, 16259, 16261, 16263, 16265, 16267, 16269 |
| 1 | 178 | NUE_OEX_1 | YBR083W | S. cerevisiae | 15056 | Cytoplasmic | — |
| 1 | 179 | NUE_OEX_1 | YKL111C | S. cerevisiae | 15587 | Cytoplasmic | — |
| 1 | 180 | NUE_OEX_1 | YPR067W | S. cerevisiae | 16582 | Cytoplasmic | — |
| 1 | 181 | NUE_OEX_1 | B1985 | E. coli | 14839 | Cytoplasmic | — |
| 1 | 182 | NUE_OEX_1 | B3838 | E. coli | 15014 | Cytoplasmic | — |
| 1 | 183 | NUE_OEX_1 | YJL010C | S. cerevisiae | 15432 | Cytoplasmic | — |
| 1 | 184 | NUE_OEX_1 | B1267 | E. coli | 14497 | Cytoplasmic | 14709, 14711 |
| 1 | 185 | NUE_OEX_1 | B1322 | E. coli | 14718 | Cytoplasmic | — |
| 1 | 186 | NUE_OEX_1 | B1381 | E. coli | 14791 | Cytoplasmic | — |
| 1 | 187 | NUE_OEX_1 | B2646 | E. coli | 14879 | Cytoplasmic | — |
| 1 | 188 | NUE_OEX_1 | YBR191W | S. cerevisiae | 15064 | Cytoplasmic | 15218, 15220, 15222, 15224, 15226, 15228, 15230, 15232, 15234, 15236, 15238, 15240, 15242, 15244, 15246, 15248 |
| 1 | 189 | NUE_OEX_1 | YDL135C | S. cerevisiae | 15257 | Cytoplasmic | 15357, 15359, 15361, 15363, 15365, 15367, 15369, 15371 |
| 1 | 190 | NUE_OEX_1 | YHL005C | S. cerevisiae | 15378 | Cytoplasmic | — |
| 1 | 191 | NUE_OEX_1 | YKR100C_2 | S. cerevisiae | 16629 | Cytoplasmic | — |
| 1 | 192 | NUE_OEX_1 | YMR191W_2 | S. cerevisiae | 16647 | Cytoplasmic | — |

TABLE IIA

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 1 | NUE_OEX_1 | B0017 | E. coli | 39 | Cytoplasmic | — |
| 1 | 2 | NUE_OEX_1 | B0045 | E. coli | 43 | Cytoplasmic | 45, 47, 49, 51, 53, 55, 57, 59, 61, 63, 65, 67, 69, 71, 73, 75, 77, 79, 81, 83, 85, 87, 89, 91, 93, 95, 97 |
| 1 | 3 | NUE_OEX_1 | B0180 | E. coli | 124 | Plastidic | 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364 |
| 1 | 4 | NUE_OEX_1 | B0242 | E. coli | 381 | Plastidic | 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661 |
| 1 | 5 | NUE_OEX_1 | B0403 | E. coli | 680 | Plastidic | 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 6 | NUE_OEX_1 | B0474 | E. coli | 813 | Cytoplasmic | 754, 756, 758, 760, 762, 764, 766, 768, 770, 772, 774, 776, 778, 780, 782, 784, 786, 788, 790, 792, 794, 796, 798, 800 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957 |
| 1 | 7 | NUE_OEX_1 | B0754 | E. coli | 1056 | Plastidic | 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1290, 1292, 1294, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550 |
| 1 | 8 | NUE_OEX_1 | B0784 | E. coli | 1564 | Cytoplasmic | 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700 |
| 1 | 9 | NUE_OEX_1 | B0873 | E. coli | 1706 | Plastidic | 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830 |
| 1 | 10 | NUE_OEX_1 | B1014 | E. coli | 1845 | Cytoplasmic | 1847, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931 |
| 1 | 11 | NUE_OEX_1 | B1020 | E. coli | 1951 | Plastidic | 1953, 1955, 1957, 1959, 1961, 1963, 1965 |
| 1 | 12 | NUE_OEX_1 | B1180 | E. coli | 1976 | Cytoplasmic | 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098 |
| 1 | 13 | NUE_OEX_1 | B1933 | E. coli | 2128 | Plastidic | 2130, 2132 |
| 1 | 14 | NUE_OEX_1 | B2032 | E. coli | 2136 | Plastidic | 2138, 2140, 2142, 2144, 2146, 2148, 2150, 2152, 2154, 2156, 2158, 2160, 2162, 2164, 2166 |
| 1 | 15 | NUE_OEX_1 | B2165 | E. coli | 2172 | Plastidic | 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284 |
| 1 | 16 | NUE_OEX_1 | B2223 | E. coli | 2298 | Plastidic | 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| | | | | | | | 2380, 2382, 2384, 2386, 2388, 2390, 2392, 2394, 2396, 2398, 2400, 2402, 2404, 2406, 2408, 2410, 2412, 2414, 2416, 2418 |
| 1 | 17 | NUE_OEX_1 | B2238 | E. coli | 2427 | Plastidic | 2429, 2431, 2433, 2435, 2437, 2439, 2441, 2443 |
| 1 | 17 | NUE_OEX_1 | B2238 | E. coli | 2427 | Cytoplasmic | 2429, 2431, 2433, 2435, 2437, 2439, 2441, 2443 |
| 1 | 18 | NUE_OEX_1 | B2310 | E. coli | 2453 | Plastidic | 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2499, 2501, 2503, 2505, 2507, 2509, 2511, 2513, 2515, 2517, 2519, 2521, 2523, 2525, 2527, 2529, 2531, 2533, 2535, 2537, 2539, 2541, 2543 |
| 1 | 19 | NUE_OEX_1 | B2431 | E. coli | 2552 | Plastidic | 2554, 2556, 2558, 2560, 2562, 2564, 2566, 2568, 2570, 2572, 2574, 2576, 2578, 2580, 2582, 2584, 2586, 2588, 2590 |
| 1 | 20 | NUE_OEX_1 | B2600 | E. coli | 2601 | Plastidic | 2603, 2605, 2607, 2609, 2611, 2613, 2615, 2617, 2619, 2621, 2623, 2625, 2627, 2629, 2631, 2633, 2635, 2637, 2639, 2641, 2643, 2645, 2647, 2649, 2651, 2653, 2655, 2657 |
| 1 | 21 | NUE_OEX_1 | B2766 | E. coli | 2669 | Plastidic | 2671, 2673, 2675, 2677, 2679, 2681, 2683, 2685, 2687, 2689, 2691, 2693, 2695, 2697, 2699, 2701, 2703, 2705, 2707, 2709, 2711, 2713, 2715, 2717, 2719, 2721, 2723, 2725, 2727, 2729, 2731, 2733, 2735, 2737, 2739, 2741, 2743, 2745, 2747, 2749, 2751, 2753, 2755, 2757, 2759, 2761, 2763, 2765 |
| 1 | 22 | NUE_OEX_1 | B2903 | E. coli | 2773 | Cytoplasmic | 2775, 2777, 2779, 2781, 2783, 2785, 2787, 2789, 2791, 2793, 2795, 2797, 2799, 2801, 2803, 2805, 2807, 2809, 2811, 2813, 2815, 2817, 2819, 2821, 2823, 2825, 2827, 2829, 2831, 2833, 2835, 2837, 2839, 2841, 2843, 2845, 2847, 2849, 2851, 2853, 2855, 2857, 2859, 2861, 2863, 2865, 2867, 2869, 2871, 2873, 2875, 2877, 2879, 2881, 2883, 2885, 2887, 2889, 2891, 2893, 2895, 2897, 2899, 2901, 2903, 2905, 2907, 2909, 2911, 2913, 2915, 2917, 2919, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, 2969, 2971, 2973, 2975, 2977, 2979, 2981, 2983, 2985, 2987, 2989, 2991, 2993, 2995, 2997, 2999, 3001, 3003, 3005, 3007, 3009, 3011, 3013, 3015, 3017, 3019, 3021, 3023, 3025, 3027, 3029, 3031, 3033, 3035, 3037, 3039, 3041, 3043, 3045, 3047, 3049, 3051, 3053, 3055, 3057, 3059, 3061, 3063, 3065, 3067, 3069, 3071, 3073, 3075, 3077, 3079, 3081, 3083, 3085, 3087, 3089, 3091, 3093, 3095 |
| 1 | 23 | NUE_OEX_1 | B3117 | E. coli | 3118 | Plastidic | 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, 3180, 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372 |
| 1 | 24 | NUE_OEX_1 | B3120 | E. coli | 3391 | Plastidic | 3393 |
| 1 | 25 | NUE_OEX_1 | B3216 | E. coli | 3397 | Plastidic | 3399, 3401, 3403, 3405, 3407, 3409, 3411, 3413, 3415, 3417, 3419, 3421, 3423, 3425, 3427, 3429, 3431, 3433, 3435, 3437, 3439, 3441, 3443, 3445, 3447, 3449, 3451, 3453, 3455, 3457, 3459, 3461, 3463, 3465 |
| 1 | 26 | NUE_OEX_1 | B3451 | E. coli | 3471 | Plastidic | 3473, 3475, 3477, 3479, 3481, 3483, 3485, 3487, 3489, 3491, 3493, 3495, 3497, 3499, 3501, 3503, 3505, 3507, 3509, 3511, 3513, 3515, 3517, 3519, 3521, 3523, 3525, 3527, 3529, 3531, 3533, 3535, 3537, 3539, 3541, 3543, 3545, 3547, 3549, 3551, 3553, 3555 |
| 1 | 27 | NUE_OEX_1 | B3791 | E. coli | 3564 | Cytoplasmic | 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, 3652, 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3760, 3762, 3764 |
| 1 | 28 | NUE_OEX_1 | B3825 | E. coli | 3771 | Plastidic | 3773, 3775, 3777, 3779, 3781, 3783, 3785, 3787, 3789, 3791, 3793, 3795, 3797, 3799, 3801, 3803, 3805, 3807, 3809, 3811, 3813, 3815, 3817, 3819, 3821, 3823, 3825, 3827, 3829, 3831, |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| | | | | | | | 3833, 3835, 3837, 3839, 3841, 3843, 3845, 3847, 3849, 3851, 3853, 3855, 3857, 3859, 3861, 3863 |
| 1 | 29 | NUE_OEX_1 | YAL019W | S. cerevisiae | 3869 | Cytoplasmic | 3871, 3873, 3875, 3877 |
| 1 | 30 | NUE_OEX_1 | YAR035W | S. cerevisiae | 3896 | Cytoplasmic | 3898, 3900, 3902, 3904, 3906, 3908, 3910, 3912, 3914, 3916, 3918, 3920, 3922, 3924, 3926, 3928, 3930, 3932, 3934, 3936, 3938, 3940 |
| 1 | 31 | NUE_OEX_1 | YBL021C | S. cerevisiae | 3954 | Cytoplasmic | 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030 |
| 1 | 32 | NUE_OEX_1 | YBR055C | S. cerevisiae | 4112 | Cytoplasmic | 4114, 4116, 4118, 4120, 4122, 4124, 4126, 4128, 4130, 4132, 4134, 4136, 4138, 4140 |
| 1 | 33 | NUE_OEX_1 | YBR128C | S. cerevisiae | 4150 | Cytoplasmic | 4152, 4154, 4156 |
| 1 | 34 | NUE_OEX_1 | YBR159W | S. cerevisiae | 4163 | Cytoplasmic | 4165, 4167, 4169, 4171, 4173, 4175, 4177, 4179, 4181, 4183, 4185, 4187, 4189, 4191, 4193, 4195, 4197, 4199, 4201, 4203, 4205, 4207, 4209, 4211, 4213 |
| 1 | 35 | NUE_OEX_1 | YBR243C | S. cerevisiae | 4236 | Cytoplasmic | 4238, 4240, 4242, 4244, 4246, 4248, 4250, 4252, 4254, 4256, 4258, 4260, 4262, 4264, 4266 |
| 1 | 35 | NUE_OEX_1 | YBR243C | S. cerevisiae | 4236 | Plastidic | 4238, 4240, 4242, 4244, 4246, 4248, 4250, 4252, 4254, 4256, 4258, 4260, 4262, 4264, 4266 |
| 1 | 36 | NUE_OEX_1 | YBR262C | S. cerevisiae | 4281 | Cytoplasmic | 4283, 4285 |
| 1 | 37 | NUE_OEX_1 | YCR019W | S. cerevisiae | 4289 | Cytoplasmic | 4291, 4293, 4295, 4297, 4299, 4301, 4303, 4305 |
| 1 | 38 | NUE_OEX_1 | YDR070C | S. cerevisiae | 4316 | Cytoplasmic | 4318, 4320 |
| 1 | 39 | NUE_OEX_1 | YDR079W | S. cerevisiae | 4326 | Cytoplasmic | 4328, 4330 |
| 1 | 40 | NUE_OEX_1 | YDR123C | S. cerevisiae | 4336 | Cytoplasmic | 4338, 4340 |
| 1 | 41 | NUE_OEX_1 | YDR137W | S. cerevisiae | 4347 | Cytoplasmic | 4349, 4351 |
| 1 | 42 | NUE_OEX_1 | YDR294C | S. cerevisiae | 4362 | Cytoplasmic | 4364, 4366, 4368, 4370, 4372, 4374, 4376, 4378, 4380, 4382, 4384, 4386, 4388, 4390 |
| 1 | 42 | NUE_OEX_1 | YDR294C | S. cerevisiae | 4362 | Plastidic | 4364, 4366, 4368, 4370, 4372, 4374, 4376, 4378, 4380, 4382, 4384, 4386, 4388, 4390 |
| 1 | 43 | NUE_OEX_1 | YDR330W | S. cerevisiae | 4403 | Cytoplasmic | 4405, 4407, 4409, 4411, 4413, 4415, 4417, 4419, 4421, 4423 |
| 1 | 44 | NUE_OEX_1 | YDR355C | S. cerevisiae | 4432 | Cytoplasmic | — |
| 1 | 45 | NUE_OEX_1 | YDR430C | S. cerevisiae | 4436 | Plastidic | 4438, 4440, 4442, 4444, 4446, 4448, 4450, 4452, 4454, 4456, 4458, 4460, 4462, 4464, 4466, 4468 |
| 1 | 46 | NUE_OEX_1 | YDR472W | S. cerevisiae | 4486 | Cytoplasmic | 4488, 4490, 4492, 4494, 4496 |
| 1 | 47 | NUE_OEX_1 | YDR497C | S. cerevisiae | 4507 | Plastidic | 4509, 4511, 4513, 4515, 4517, 4519, 4521, 4523, 4525, 4527, 4529, 4531, 4533, 4535, 4537, 4539, 4541, 4543, 4545, 4547, 4549, 4551, 4553, 4555, 4557, 4559, 4561, 4563, 4565, 4567, 4569, 4571, 4573, 4575, 4577, 4579, 4581, 4583, 4585, 4587, 4589, 4591, 4593, 4595, 4597, 4599, 4601, 4603, 4605, 4607, 4609, 4611, 4613, 4615, 4617, 4619, 4621, 4623, 4625, 4627, 4629, 4631, 4633, 4635, 4637, 4639, 4641, 4643, 4645, 4647, 4649, 4651, 4653, 4655, 4657, 4659, 4661, 4663, 4665, 4667, 4669, 4671, 4673, 4675, 4677, 4679, 4681, 4683, 4685, 4687, 4689, 4691, 4693, 4695, 4697, 4699, 4701, 4703, 4705, 4707, 4709, 4711, 4713, 4715, 4717, 4719, 4721, 4723, 4725, 4727, 4729, 4731, 4733, 4735, 4737 |
| 1 | 48 | NUE_OEX_1 | YER029C | S. cerevisiae | 4791 | Cytoplasmic | 4793, 4795, 4797, 4799 |
| 1 | 49 | NUE_OEX_1 | YFR007W | S. cerevisiae | 4807 | Cytoplasmic | 4809, 4811, 4813, 4815, 4817, 4819, 4821, 4823, 4825, 4827, 4829 |
| 1 | 50 | NUE_OEX_1 | YGL039W | S. cerevisiae | 4837 | Cytoplasmic | 4839, 4841, 4843, 4845, 4847, 4849, 4851, 4853, 4855, 4857, 4859, 4861, 4863, 4865, 4867, 4869, 4871, 4873, 4875, 4877, 4879, 4881, 4883, 4885, 4887, 4889, 4891, 4893, 4895, 4897, 4899, 4901, 4903, 4905, 4907, 4909, 4911, 4913, 4915, 4917, 4919, 4921, 4923, 4925, 4927, 4929, 4931, 4933, 4935, 4937, 4939, 4941, 4943, 4945, 4947, 4949, 4951, 4953, 4955, 4957, 4959, 4961, 4963, 4965, 4967, 4969, 4971, 4973, 4975, 4977, 4979, 4981, 4983, 4985, 4987, 4989, 4991, 4993, 4995, 4997, 4999, 5001, 5003, 5005, 5007, 5009, 5011, 5013, 5015, 5017, 5019, 5021, 5023, 5025, 5027, 5029, 5031, 5033, 5035, 5037, 5039, 5041, 5043, 5045, 5047, 5049, 5051, 5053, 5055, 5057, 5059, 5061, 5063, 5065, 5067, 5069, 5071, 5073, 5075, 5077, 5079, 5081, 5083, 5085, 5087, 5089, 5091, 5093, 5095, 5097, 5099, 5101, 5103, 5105, 5107, 5109, 5111, 5113, 5115, 5117, 5119, 5121, 5123, 5125, 5127, 5129, 5131, 5133, 5135, 5137, 5139, 5141, 5143, 5145, 5147, 5149, 5151, 5153, 5155, 5157, 5159, 5161, 5163, 5165, 5167, 5169, 5171, 5173, 5175, 5177, 5179, 5181, 5183, 5185, 5187, 5189, 5191, 5193, 5195, 5197, 5199, 5201, 5203, 5205, 5207, 5209, 5211, 5213 |
| 1 | 51 | NUE_OEX_1 | YGL043W | S. cerevisiae | 5312 | Cytoplasmic | 5314, 5316, 5318, 5320, 5322, 5324, 5326, 5328, 5330, 5332, 5334 |
| 1 | 52 | NUE_OEX_1 | YGR088W | S. cerevisiae | 5347 | Cytoplasmic | 5349, 5351, 5353, 5355, 5357, 5359, 5361, 5363, 5365, 5367, 5369, 5371, 5373, 5375, 5377, 5379, 5381, 5383, 5385, 5387, |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| | | | | | | | 5389, 5391, 5393, 5395, 5397, 5399, 5401, 5403, 5405, 5407, 5409, 5411, 5413, 5415, 5417, 5419, 5421, 5423, 5425, 5427, 5429, 5431, 5433, 5435, 5437, 5439, 5441, 5443, 5445, 5447, 5449, 5451, 5453, 5455, 5457, 5459, 5461, 5463, 5465, 5467, 5469, 5471, 5473, 5475, 5477, 5479, 5481, 5483, 5485, 5487, 5489, 5491, 5493, 5495, 5497, 5499, 5501, 5503, 5505, 5507, 5509, 5511, 5513, 5515, 5517, 5519, 5521, 5523 |
| 1 | 53 | NUE_OEX_1 | YGR122C-A | S. cerevisiae | 5534 | Cytoplasmic | 5536, 5538, 5540, 5542, 5544, 5546 |
| 1 | 54 | NUE_OEX_1 | YGR142W | S. cerevisiae | 5552 | Cytoplasmic | 5554, 5556 |
| 1 | 55 | NUE_OEX_1 | YGR143W | S. cerevisiae | 5560 | Cytoplasmic | 5562, 5564, 5566, 5568, 5570, 5572, 5574, 5576, 5578, 5580, 5582, 5584, 5586 |
| 1 | 56 | NUE_OEX_1 | YGR165W | S. cerevisiae | 5603 | Cytoplasmic | 5605 |
| 1 | 57 | NUE_OEX_1 | YGR170W | S. cerevisiae | 5609 | Cytoplasmic | 5611 |
| 1 | 58 | NUE_OEX_1 | YGR202C | S. cerevisiae | 5615 | Cytoplasmic | 5617, 5619, 5621, 5623, 5625, 5627, 5629, 5631, 5633, 5635, 5637, 5639, 5641, 5643, 5645, 5647, 5649, 5651, 5653, 5655, 5657, 5659 |
| 1 | 59 | NUE_OEX_1 | YGR266W | S. cerevisiae | 5667 | Cytoplasmic | 5669, 5671, 5673, 5675, 5677, 5679, 5681, 5683, 5685, 5687 |
| 1 | 60 | NUE_OEX_1 | YGR282C | S. cerevisiae | 5702 | Cytoplasmic | 5704, 5706, 5708, 5710, 5712, 5714, 5716, 5718, 5720, 5722, 5724, 5726, 5728, 5730, 5732, 5734, 5736, 5738, 5740 |
| 1 | 61 | NUE_OEX_1 | YGR290W | S. cerevisiae | 5751 | Cytoplasmic | — |
| 1 | 62 | NUE_OEX_1 | YHL021C | S. cerevisiae | 5755 | Cytoplasmic | 5757, 5759, 5761, 5763, 5765, 5767, 5769 |
| 1 | 63 | NUE_OEX_1 | YHL031C | S. cerevisiae | 5779 | Cytoplasmic | 5781, 5783, 5785, 5787, 5789, 5791, 5793, 5795, 5797, 5799, 5801, 5803, 5805, 5807 |
| 1 | 64 | NUE_OEX_1 | YHR011W | S. cerevisiae | 5813 | Cytoplasmic | 5815, 5817, 5819, 5821, 5823, 5825, 5827, 5829, 5831, 5833, 5835, 5837, 5839, 5841, 5843, 5845, 5847, 5849, 5851, 5853, 5855, 5857, 5859, 5861, 5863, 5865, 5867, 5869, 5871, 5873, 5875, 5877, 5879, 5881, 5883, 5885, 5887, 5889, 5891, 5893, 5895, 5897, 5899, 5901, 5903, 5905, 5907, 5909, 5911, 5913, 5915, 5917, 5919, 5921, 5923, 5925, 5927, 5929, 5931, 5933, 5935, 5937, 5939, 5941, 5943, 5945, 5947, 5949, 5951, 5953 |
| 1 | 65 | NUE_OEX_1 | YHR127W | S. cerevisiae | 5968 | Cytoplasmic | 5970 |
| 1 | 66 | NUE_OEX_1 | YHR137W | S. cerevisiae | 5974 | Cytoplasmic | 5976, 5978, 5980, 5982, 5984, 5986, 5988, 5990, 5992, 5994, 5996, 5998, 6000, 6002, 6004, 6006, 6008, 6010, 6012, 6014, 6016, 6018, 6020 |
| 1 | 66 | NUE_OEX_1 | YHR137W | S. cerevisiae | 5974 | Plastidic | 5976, 5978, 5980, 5982, 5984, 5986, 5988, 5990, 5992, 5994, 5996, 5998, 6000, 6002, 6004, 6006, 6008, 6010, 6012, 6014, 6016, 6018, 6020 |
| 1 | 67 | NUE_OEX_1 | YIL099W | S. cerevisiae | 6028 | Cytoplasmic | 6030, 6032, 6034, 6036, 6038, 6040, 6042, 6044, 6046, 6048, 6050, 6052, 6054, 6056, 6058, 6060, 6062, 6064, 6066, 6068, 6070, 6072, 6074, 6076, 6078, 6080, 6082, 6084, 6086, 6088, 6090, 6092, 6094, 6096, 6098 |
| 1 | 67 | NUE_OEX_1 | YIL099W | S. cerevisiae | 6028 | Plastidic | 6030, 6032, 6034, 6036, 6038, 6040, 6042, 6044, 6046, 6048, 6050, 6052, 6054, 6056, 6058, 6060, 6062, 6064, 6066, 6068, 6070, 6072, 6074, 6076, 6078, 6080, 6082, 6084, 6086, 6088, 6090, 6092, 6094, 6096, 6098 |
| 1 | 68 | NUE_OEX_1 | YIL147C | S. cerevisiae | 6108 | Cytoplasmic | 6110, 6112, 6114, 6116, 6118, 6120, 6122, 6124, 6126, 6128, 6130, 6132 |
| 1 | 69 | NUE_OEX_1 | YIR034C | S. cerevisiae | 6151 | Cytoplasmic | 6153, 6155, 6157, 6159, 6161, 6163, 6165, 6167, 6169, 6171, 6173, 6175, 6177, 6179, 6181, 6183, 6185 |
| 1 | 70 | NUE_OEX_1 | YJL013C | S. cerevisiae | 6199 | Cytoplasmic | 6201, 6203, 6205 |
| 1 | 71 | NUE_OEX_1 | YJL041W | S. cerevisiae | 6209 | Cytoplasmic | 6211, 6213, 6215, 6217, 6219, 6221, 6223, 6225, 6227, 6229, 6231, 6233, 6235 |
| 1 | 72 | NUE_OEX_1 | YJL064W | S. cerevisiae | 6243 | Cytoplasmic | — |
| 1 | 73 | NUE_OEX_1 | YJL067W | S. cerevisiae | 6247 | Cytoplasmic | — |
| 1 | 74 | NUE_OEX_1 | YJL094C | S. cerevisiae | 6251 | Cytoplasmic | 6253, 6255, 6257, 6259, 6261, 6263, 6265, 6267, 6269, 6271, 6273, 6275, 6277, 6279, 6281, 6283, 6285 |
| 1 | 75 | NUE_OEX_1 | YJL171C | S. cerevisiae | 6298 | Cytoplasmic | 6300, 6302, 6304, 6306, 6308, 6310, 6312, 6314, 6316 |
| 1 | 76 | NUE_OEX_1 | YJL213W | S. cerevisiae | 6327 | Cytoplasmic | 6329, 6331, 6333, 6335, 6337, 6339, 6341, 6343, 6345, 6347, 6349, 6351, 6353, 6355, 6357, 6359, 6361, 6363, 6365, 6367, 6369, 6371, 6373, 6375, 6377, 6379, 6381, 6383, 6385, 6387, 6389, 6391, 6393, 6395, 6397, 6399, 6401, 6403, 6405, 6407, 6409, 6411, 6413, 6415, 6417, 6419, 6421, 6423, 6425, 6427, 6429, 6431, 6433, 6435, 6437, 6439, 6441, 6443, 6445, 6447, 6449, 6451, 6453, 6455, 6457, 6459, 6461, 6463, 6465, 6467, 6469, 6471, 6473, 6475, 6477, 6479, 6481 |
| 1 | 77 | NUE_OEX_1 | YJR017C | S. cerevisiae | 6489 | Cytoplasmic | 6491, 6493, 6495, 6497, 6499, 6501, 6503, 6505, 6507, 6509, 6511, 6513, 6515, 6517, 6519, 6521, 6523, 6525, 6527, 6529, 6531, 6533, 6535, 6537, 6539, 6541 |
| 1 | 78 | NUE_OEX_1 | YJR058C | S. cerevisiae | 6551 | Cytoplasmic | 6553, 6555, 6557, 6559, 6561, 6563, 6565, 6567, 6569, 6571, 6573, 6575, 6577, 6579, 6581, 6583, 6585, 6587, 6589, 6591, 6593, 6595, 6597, 6599, 6601, 6603, 6605, 6607, 6609, 6611, 6613, 6615, 6617, 6619, 6621, 6623, 6625, 6627, 6629, 6631, |

TABLE IIA-continued

| | | | | | 5. Lead | | |
|---|---|---|---|---|---|---|---|
| Ap-plica-tion | 1. Hit | 2. Project | 3. Locus | 4. Organism | SEQ ID | 6. Target | 7. SEQ IDs of Polypeptide Homologs |
| 1 | 79 | NUE_OEX_1 | YJR117W | S. cerevisiae | 6701 | Cytoplasmic | 6633, 6635, 6637, 6639, 6641, 6643, 6645, 6647, 6649, 6651, 6653, 6655, 6657, 6659, 6661 6703, 6705, 6707, 6709, 6711, 6713, 6715, 6717, 6719, 6721, 6723, 6725, 6727, 6729, 6731, 6733, 6735, 6737, 6739, 6741, 6743, 6745, 6747, 6749, 6751, 6753, 6755, 6757, 6759, 6761, 6763, 6765, 6767, 6769, 6771, 6773, 6775, 6777, 6779, 6781, 6783, 6785, 6787, 6789 |
| 1 | 80 | NUE_OEX_1 | YJR121W | S. cerevisiae | 6817 | Cytoplasmic | 6819, 6821, 6823, 6825, 6827, 6829, 6831, 6833, 6835, 6837, 6839, 6841, 6843, 6845, 6847, 6849, 6851, 6853, 6855, 6857, 6859, 6861, 6863, 6865, 6867, 6869, 6871, 6873, 6875, 6877, 6879, 6881, 6883, 6885, 6887, 6889, 6891, 6893, 6895, 6897, 6899, 6901, 6903, 6905, 6907, 6909, 6911, 6913, 6915, 6917, 6919, 6921, 6923, 6925, 6927, 6929, 6931, 6933, 6935, 6937, 6939, 6941, 6943, 6945, 6947, 6949, 6951, 6953, 6955, 6957, 6959, 6961, 6963, 6965, 6967, 6969, 6971, 6973, 6975, 6977, 6979, 6981, 6983, 6985, 6987, 6989, 6991, 6993, 6995, 6997, 6999, 7001, 7003, 7005, 7007, 7009, 7011, 7013, 7015, 7017, 7019, 7021, 7023, 7025, 7027, 7029, 7031, 7033, 7035, 7037, 7039, 7041, 7043, 7045, 7047, 7049, 7051, 7053, 7055, 7057, 7059, 7061, 7063, 7065, 7067, 7069, 7071, 7073, 7075, 7077, 7079, 7081, 7083, 7085, 7087, 7089, 7091, 7093, 7095, 7097, 7099, 7101, 7103, 7105, 7107, 7109, 7111, 7113, 7115, 7117, 7119, 7121, 7123, 7125, 7127, 7129, 7131, 7133, 7135, 7137, 7139, 7141, 7143, 7145, 7147, 7149, 7151, 7153, 7155, 7157, 7159, 7161, 7163, 7165, 7167, 7169, 7171, 7173, 7175, 7177, 7179, 7181, 7183, 7185, 7187, 7189, 7191, 7193, 7195, 7197, 7199, 7201, 7203, 7205, 7207, 7209, 7211, 7213, 7215, 7217, 7219, 7221, 7223, 7225, 7227, 7229, 7231, 7233, 7235, 7237, 7239, 7241, 7243, 7245, 7247, 7249, 7251, 7253, 7255, 7257, 7259, 7261, 7263, 7265, 7267, 7269, 7271, 7273, 7275, 7277, 7279, 7281, 7283, 7285, 7287, 7289, 7291, 7293, 7295, 7297, 7299, 7301, 7303, 7305, 7307, 7309, 7311, 7313, 7315, 7317, 7319, 7321, 7323, 7325, 7327, 7329, 7331, 7333, 7335 |
| 1 | 81 | NUE_OEX_1 | YJR131W | S. cerevisiae | 7367 | Cytoplasmic | 7369, 7371, 7373, 7375, 7377, 7379, 7381, 7383, 7385, 7387, 7389, 7391, 7393, 7395, 7397, 7399, 7401, 7403, 7405, 7407, 7409, 7411, 7413, 7415, 7417, 7419, 7421, 7423, 7425, 7427, 7429, 7431, 7433, 7435, 7437, 7439, 7441, 7443, 7445, 7447, 7449, 7451, 7453, 7455, 7457, 7459 |
| 1 | 82 | NUE_OEX_1 | YJR145C | S. cerevisiae | 7476 | Cytoplasmic | 7478, 7480, 7482, 7484, 7486, 7488, 7490, 7492, 7494, 7496, 7498, 7500, 7502, 7504, 7506, 7508, 7510, 7512, 7514, 7516, 7518, 7520, 7522, 7524, 7526, 7528, 7530, 7532, 7534, 7536, 7538, 7540, 7542, 7544, 7546, 7548, 7550, 7552, 7554, 7556, 7558 |
| 1 | 83 | NUE_OEX_1 | YKL084W | S. cerevisiae | 7603 | Cytoplasmic | 7605, 7607, 7609, 7611, 7613, 7615, 7617, 7619, 7621, 7623, 7625, 7627, 7629, 7631, 7633, 7635, 7637, 7639, 7641, 7643, 7645 |
| 1 | 84 | NUE_OEX_1 | YKL088W | S. cerevisiae | 7652 | Cytoplasmic | 7654 |
| 1 | 85 | NUE_OEX_1 | YKL100C | S. cerevisiae | 7662 | Cytoplasmic | 7664, 7666, 7668 |
| 1 | 86 | NUE_OEX_1 | YKL131W | S. cerevisiae | 7676 | Cytoplasmic | — |
| 1 | 87 | NUE_OEX_1 | YKL138C | S. cerevisiae | 7680 | Cytoplasmic | 7682, 7684, 7686, 7688, 7690, 7692, 7694, 7696, 7698, 7700, 7702, 7704 |
| 1 | 88 | NUE_OEX_1 | YKL178C | S. cerevisiae | 7711 | Cytoplasmic | 7713, 7715, 7717, 7719 |
| 1 | 89 | NUE_OEX_1 | YKL179C | S. cerevisiae | 7736 | Cytoplasmic | 7738, 7740, 7742, 7744, 7746, 7748, 7750, 7752, 7754, 7756, 7758, 7760, 7762, 7764, 7766, 7768 |
| 1 | 90 | NUE_OEX_1 | YKL193C | S. cerevisiae | 7779 | Cytoplasmic | 7781, 7783, 7785, 7787, 7789, 7791, 7793, 7795, 7797, 7799, 7801, 7803, 7805, 7807, 7809, 7811, 7813 |
| 1 | 91 | NUE_OEX_1 | YKL216W | S. cerevisiae | 7830 | Cytoplasmic | 7832, 7834, 7836, 7838, 7840, 7842, 7844, 7846, 7848, 7850, 7852, 7854, 7856, 7858, 7860, 7862, 7864, 7866, 7868, 7870, 7872, 7874, 7876, 7878, 7880, 7882, 7884, 7886, 7888, 7890, 7892, 7894, 7896, 7898, 7900, 7902, 7904, 7906, 7908, 7910, 7912, 7914, 7916, 7918, 7920, 7922, 7924, 7926, 7928, 7930, 7932, 7934, 7936, 7938, 7940, 7942, 7944, 7946, 7948, 7950, 7952, 7954, 7956, 7958, 7960, 7962, 7964, 7966, 7968, 7970, 7972, 7974, 7976, 7978, 7980, 7982, 7984, 7986, 7988, 7990, 7992, 7994, 7996, 7998, 8000, 8002, 8004, 8006, 8008, 8010, 8012 |
| 1 | 92 | NUE_OEX_1 | YKR016W | S. cerevisiae | 8018 | Cytoplasmic | 8020, 8022, 8024, 8026, 8028, 8030, 8032, 8034, 8036, 8038 |
| 1 | 93 | NUE_OEX_1 | YKR021W | S. cerevisiae | 8046 | Cytoplasmic | 8048, 8050, 8052, 8054, 8056, 8058, 8060 |
| 1 | 94 | NUE_OEX_1 | YKR055W | S. cerevisiae | 8074 | Cytoplasmic | 8076, 8078, 8080, 8082, 8084, 8086, 8088, 8090, 8092, 8094, 8096, 8098, 8100, 8102, 8104, 8106, 8108, 8110, 8112, 8114, 8116, 8118, 8120, 8122, 8124, 8126, 8128, 8130, 8132, 8134, 8136, 8138, 8140, 8142, 8144, 8146, 8148, 8150, 8152, 8154, 8156, 8158, 8160, 8162, 8164, 8166, 8168, 8170, 8172, 8174, |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| | | | | | | | 8176, 8178, 8180, 8182, 8184, 8186, 8188, 8190, 8192, 8194, 8196, 8198, 8200, 8202, 8204, 8206, 8208, 8210, 8212, 8214, 8216, 8218, 8220, 8222, 8224, 8226, 8228, 8230, 8232, 8234, 8236, 8238, 8240, 8242, 8244, 8246, 8248, 8250, 8252, 8254, 8256 |
| 1 | 95 | NUE_OEX_1 | YKR088C | S. cerevisiae | 8264 | Plastidic | 8266, 8268, 8270, 8272, 8274, 8276, 8278, 8280 |
| 1 | 96 | NUE_OEX_1 | YKR093W | S. cerevisiae | 8288 | Cytoplasmic | 8290, 8292, 8294, 8296, 8298, 8300, 8302, 8304, 8306, 8308, 8310, 8312, 8314, 8316, 8318, 8320, 8322, 8324, 8326, 8328, 8330, 8332, 8334, 8336, 8338, 8340, 8342, 8344, 8346, 8348, 8350, 8352, 8354, 8356, 8358, 8360, 8362, 8364, 8366, 8368, 8370, 8372, 8374, 8376, 8378, 8380, 8382, 8384, 8386, 8388, 8390, 8392, 8394, 8396, 8398, 8400, 8402, 8404, 8406, 8408, 8410, 8412, 8414, 8416, 8418, 8420, 8422, 8424, 8426, 8428, 8430, 8432, 8434, 8436, 8438, 8440, 8442 |
| 1 | 97 | NUE_OEX_1 | YKR099W | S. cerevisiae | 8469 | Cytoplasmic | 8471, 8473 |
| 1 | 98 | NUE_OEX_1 | YKR100C | S. cerevisiae | 8485 | Cytoplasmic | 8487, 8489 |
| 1 | 99 | NUE_OEX_1 | YLL014W | S. cerevisiae | 8493 | Cytoplasmic | 8495, 8497, 8499, 8501, 8503, 8505, 8507, 8509 |
| 1 | 100 | NUE_OEX_1 | YLL016W | S. cerevisiae | 8515 | Cytoplasmic | 8517, 8519, 8521, 8523, 8525, 8527 |
| 1 | 101 | NUE_OEX_1 | YLL023C | S. cerevisiae | 8540 | Cytoplasmic | 8542, 8544, 8546, 8548, 8550, 8552, 8554, 8556, 8558, 8560, 8562, 8564, 8566 |
| 1 | 102 | NUE_OEX_1 | YLL037W | S. cerevisiae | 8572 | Cytoplasmic | — |
| 1 | 103 | NUE_OEX_1 | YLL049W | S. cerevisiae | 8576 | Cytoplasmic | — |
| 1 | 104 | NUE_OEX_1 | YLL055W | S. cerevisiae | 8580 | Cytoplasmic | 8582, 8584, 8586, 8588, 8590, 8592, 8594, 8596, 8598, 8600, 8602, 8604, 8606, 8608, 8610, 8612, 8614, 8616, 8618, 8620, 8622, 8624, 8626, 8628, 8630, 8632, 8634, 8636, 8638, 8640, 8642, 8644, 8646, 8648, 8650, 8652, 8654, 8656 |
| 1 | 105 | NUE_OEX_1 | YLR034C | S. cerevisiae | 8662 | Cytoplasmic | 8664, 8666, 8668, 8670, 8672, 8674, 8676, 8678, 8680, 8682, 8684, 8686, 8688, 8690, 8692, 8694, 8696, 8698, 8700, 8702, 8704, 8706, 8708, 8710, 8712, 8714, 8716, 8718, 8720, 8722, 8724, 8726, 8728, 8730, 8732, 8734, 8736, 8738, 8740, 8742, 8744, 8746, 8748, 8750, 8752, 8754, 8756, 8758, 8760, 8762, 8764, 8766, 8768, 8770, 8772, 8774, 8776, 8778, 8780, 8782, 8784, 8786, 8788, 8790, 8792, 8794, 8796, 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848, 8850, 8852, 8854, 8856, 8858, 8860, 8862, 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8948, 8950, 8952, 8954, 8956, 8958, 8960, 8962 |
| 1 | 106 | NUE_OEX_1 | YLR042C | S. cerevisiae | 8992 | Cytoplasmic | — |
| 1 | 107 | NUE_OEX_1 | YLR053C | S. cerevisiae | 8996 | Cytoplasmic | — |
| 1 | 108 | NUE_OEX_1 | YLR058C | S. cerevisiae | 9000 | Cytoplasmic | 9002, 9004, 9006, 9008, 9010, 9012, 9014, 9016, 9018, 9020, 9022, 9024, 9026, 9028, 9030, 9032, 9034, 9036, 9038, 9040, 9042, 9044, 9046, 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, 9106, 9108, 9110, 9112, 9114, 9116, 9118, 9120, 9122, 9124, 9126, 9128, 9130, 9132, 9134, 9136, 9138, 9140, 9142, 9144, 9146, 9148, 9150, 9152, 9154, 9156, 9158, 9160, 9162, 9164, 9166, 9168, 9170, 9172, 9174, 9176, 9178, 9180, 9182, 9184, 9186, 9188, 9190, 9192, 9194, 9196, 9198, 9200, 9202, 9204, 9206, 9208, 9210, 9212, 9214, 9216, 9218, 9220, 9222, 9224, 9226, 9228, 9230, 9232, 9234, 9236, 9238, 9240, 9242, 9244, 9246, 9248, 9250, 9252, 9254, 9256, 9258, 9260, 9262, 9264, 9266, 9268, 9270, 9272, 9274, 9276, 9278, 9280, 9282, 9284, 9286, 9288, 9290, 9292, 9294, 9296, 9298, 9300, 9302, 9304, 9306, 9308, 9310, 9312, 9314, 9316, 9318, 9320, 9322, 9324, 9326, 9328, 9330, 9332, 9334, 9336, 9338, 9340, 9342, 9344, 9346, 9348, 9350, 9352, 9354, 9356, 9358, 9360, 9362, 9364, 9366, 9368, 9370, 9372, 9374, 9376, 9378, 9380, 9382, 9384, 9386, 9388, 9390, 9392, 9394, 9396, 9398, 9400, 9402, 9404, 9406, 9408, 9410, 9412, 9414, 9416, 9418, 9420, 9422, 9424, 9426, 9428, 9430, 9432, 9434, 9436, 9438, 9440, 9442, 9444, 9446, 9448, 9450, 9452, 9454, 9456, 9458, 9460, 9462, 9464, 9466, 9468, 9470, 9472, 9474, 9476, 9478, 9480, 9482, 9484, 9486, 9488, 9490, 9492, 9494, 9496, 9498, 9500 |
| 1 | 109 | NUE_OEX_1 | YLR060W | S. cerevisiae | 9552 | Cytoplasmic | 9554, 9556, 9558, 9560, 9562, 9564, 9566, 9568, 9570, 9572, 9574, 9576, 9578, 9580, 9582, 9584, 9586, 9588, 9590, 9592, 9594, 9596, 9598, 9600, 9602, 9604, 9606, 9608, 9610, 9612, 9614, 9616, 9618, 9620, 9622, 9624, 9626, 9628 |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 110 | NUE_OEX_1 | YLR065C | S. cerevisiae | 9638 | Cytoplasmic | 9640, 9642, 9644, 9646, 9648, 9650, 9652, 9654, 9656, 9658, 9660, 9662, 9664, 9666, 9668 |
| 1 | 111 | NUE_OEX_1 | YLR070C | S. cerevisiae | 9673 | Cytoplasmic | 9675, 9677, 9679, 9681, 9683, 9685, 9687, 9689, 9691, 9693, 9695, 9697, 9699, 9701, 9703, 9705, 9707, 9709, 9711, 9713, 9715, 9717, 9719, 9721, 9723, 9725, 9727, 9729, 9731, 9733, 9735, 9737, 9739, 9741, 9743, 9745, 9747, 9749, 9751, 9753, 9755, 9757, 9759, 9761, 9763, 9765, 9767, 9769, 9771, 9773, 9775, 9777, 9779, 9781, 9783, 9785, 9787, 9789, 9791, 9793, 9795, 9797, 9799, 9801, 9803, 9805, 9807, 9809, 9811, 9813, 9815, 9817, 9819, 9821, 9823, 9825, 9827, 9829, 9831, 9833, 9835, 9837, 9839, 9841, 9843, 9845, 9847, 9849, 9851, 9853, 9855, 9857, 9859, 9861, 9863, 9865, 9867, 9869, 9871, 9873, 9875, 9877, 9879, 9881, 9883, 9885, 9887, 9889, 9891, 9893, 9895, 9897, 9899, 9901, 9903, 9905, 9907, 9909, 9911, 9913, 9915, 9917, 9919, 9921, 9923, 9925, 9927, 9929, 9931, 9933, 9935, 9937, 9939, 9941, 9943, 9945, 9947, 9949, 9951, 9953, 9955, 9957, 9959, 9961, 9963, 9965, 9967, 9969, 9971, 9973, 9975, 9977, 9979, 9981, 9983, 9985, 9987, 9989, 9991, 9993, 9995, 9997, 9999, 10001, 10003, 10005, 10007, 10009, 10011, 10013, 10015, 10017, 10019, 10021, 10023, 10025, 10027, 10029, 10031, 10033, 10035, 10037, 10039, 10041, 10043, 10045, 10047, 10049, 10051, 10053, 10055, 10057, 10059, 10061, 10063, 10065, 10067, 10069, 10071, 10073, 10075, 10077, 10079, 10081, 10083, 10085, 10087, 10089, 10091, 10093, 10095, 10097, 10099, 10101, 10103, 10105, 10107, 10109, 10111, 10113, 10115, 10117 |
| 1 | 112 | NUE_OEX_1 | YLR100W | S. cerevisiae | 10183 | Cytoplasmic | 10185, 10187, 10189, 10191, 10193, 10195, 10197, 10199, 10201, 10203 |
| 1 | 113 | NUE_OEX_1 | YLR109W | S. cerevisiae | 10215 | Cytoplasmic | 10217, 10219, 10221, 10223, 10225, 10227, 10229, 10231, 10233, 10235, 10237, 10239, 10241, 10243, 10245, 10247, 10249, 10251, 10253, 10255, 10257, 10259, 10261, 10263, 10265, 10267, 10269, 10271, 10273, 10275, 10277, 10279, 10281, 10283, 10285, 10287, 10289, 10291, 10293, 10295, 10297, 10299, 10301, 10303, 10305, 10307, 10309, 10311, 10313, 10315, 10317, 10319, 10321, 10323, 10325, 10327, 10329, 10331, 10333, 10335, 10337, 10339, 10341, 10343, 10345, 10347, 10349, 10351, 10353, 10355, 10357, 10359, 10361, 10363, 10365, 10367, 10369, 10371, 10373, 10375, 10377, 10379, 10381, 10383, 10385, 10387, 10389, 10391, 10393, 10395, 10397, 10399, 10401, 10403, 10405, 10407, 10409, 10411, 10413, 10415, 10417 |
| 1 | 114 | NUE_OEX_1 | YLR125W | S. cerevisiae | 10448 | Cytoplasmic | — |
| 1 | 115 | NUE_OEX_1 | YLR127C | S. cerevisiae | 10452 | Cytoplasmic | 10454, 10456, 10458, 10460 |
| 1 | 116 | NUE_OEX_1 | YLR185W | S. cerevisiae | 10464 | Cytoplasmic | 10466, 10468, 10470, 10472, 10474, 10476, 10478, 10480, 10482, 10484, 10486, 10488, 10490, 10492, 10494, 10496, 10498, 10500, 10502, 10504, 10506, 10508, 10510, 10512 |
| 1 | 117 | NUE_OEX_1 | YLR204W | S. cerevisiae | 10534 | Cytoplasmic | 10536, 10538 |
| 1 | 117 | NUE_OEX_1 | YLR204W | S. cerevisiae | 10534 | Plastidic | 10536, 10538 |
| 1 | 118 | NUE_OEX_1 | YLR242C | S. cerevisiae | 10542 | Cytoplasmic | 10544, 10546, 10548, 10550, 10552, 10554 |
| 1 | 119 | NUE_OEX_1 | YLR293C | S. cerevisiae | 10563 | Cytoplasmic | 10565, 10567, 10569, 10571, 10573, 10575, 10577, 10579, 10581, 10583, 10585, 10587, 10589, 10591, 10593, 10595, 10597, 10599, 10601, 10603, 10605, 10607, 10609, 10611, 10613, 10615, 10617, 10619, 10621, 10623, 10625, 10627, 10629, 10631, 10633, 10635, 10637, 10639, 10641, 10643, 10645, 10647, 10649, 10651, 10653, 10655, 10657, 10659, 10661, 10663, 10665, 10667, 10669, 10671, 10673, 10675, 10677, 10679, 10681, 10683, 10685, 10687, 10689, 10691, 10693, 10695, 10697, 10699, 10701, 10703, 10705, 10707, 10709, 10711, 10713 |
| 1 | 120 | NUE_OEX_1 | YLR313C | S. cerevisiae | 10991 | Cytoplasmic | 10993, 10995 |
| 1 | 121 | NUE_OEX_1 | YLR315W | S. cerevisiae | 10999 | Cytoplasmic | 11001 |
| 1 | 122 | NUE_OEX_1 | YLR329W | S. cerevisiae | 11005 | Cytoplasmic | 11007, 11009 |
| 1 | 123 | NUE_OEX_1 | YLR362W | S. cerevisiae | 11013 | Cytoplasmic | 11015, 11017, 11019, 11021, 11023, 11025, 11027, 11029, 11031, 11033, 11035, 11037, 11039, 11041, 11043 |
| 1 | 124 | NUE_OEX_1 | YLR395C | S. cerevisiae | 11055 | Cytoplasmic | 11057, 11059, 11061 |
| 1 | 125 | NUE_OEX_1 | YLR404W | S. cerevisiae | 11067 | Cytoplasmic | 11069, 11071 |
| 1 | 126 | NUE_OEX_1 | YLR463C | S. cerevisiae | 11075 | Cytoplasmic | 11077 |
| 1 | 127 | NUE_OEX_1 | YML022W | S. cerevisiae | 11081 | Cytoplasmic | 11083, 11085, 11087, 11089, 11091, 11093, 11095, 11097, 11099, 11101, 11103, 11105, 11107, 11109, 11111, 11113, 11115, 11117, 11119, 11121, 11123, 11125, 11127, 11129, 11131, 11133, 11135, 11137, 11139, 11141, 11143, 11145, 11147, 11149, 11151, 11153, 11155, 11157, 11159, 11161, 11163, 11165, 11167, 11169, 11171, 11173, 11175, 11177, |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| | | | | | | | 11179, 11181, 11183, 11185, 11187, 11189, 11191, 11193, 11195, 11197, 11199, 11201, 11203, 11205, 11207, 11209, 11211, 11213, 11215, 11217, 11219, 11221, 11223, 11225, 11227, 11229, 11231, 11233, 11235, 11237, 11239, 11241, 11243, 11245, 11247, 11249, 11251, 11253, 11255, 11257, 11259, 11261, 11263, 11265, 11267, 11269, 11271, 11273, 11275, 11277, 11279, 11281, 11283, 11285, 11287, 11289, 11291, 11293, 11295, 11297, 11299, 11301, 11303, 11305, 11307, 11309, 11311, 11313, 11315, 11317, 11319, 11321, 11323, 11325, 11327, 11329, 11331, 11333, 11335, 11337, 11339, 11341, 11343, 11345, 11347, 11349, 11351, 11353, 11355, 11357, 11359, 11361, 11363, 11365, 11367, 11369, 11371, 11373, 11375, 11377, 11379, 11381, 11383, 11385, 11387, 11389, 11391, 11393, 11395, 11397, 11399, 11401, 11403, 11405, 11407, 11409, 11411, 11413, 11415, 11417, 11419, 11421, 11423, 11425, 11427, 11429, 11431, 11433, 11435, 11437, 11439, 11441, 11443, 11445, 11447, 11449, 11451, 11453, 11455, 11457, 11459, 11461, 11463, 11465, 11467, 11469, 11471, 11473, 11475, 11477, 11479, 11481, 11483, 11485, 11487, 11489, 11491, 11493, 11495, 11497, 11499, 11501, 11503, 11505, 11507, 11509, 11511, 11513, 11515, 11517, 11519, 11521, 11523, 11525 |
| 1 | 128 | NUE_OEX_1 | YML027W | S. cerevisiae | 11553 | Cytoplasmic | 11555, 11557, 11559, 11561, 11563 |
| 1 | 129 | NUE_OEX_1 | YML065W | S. cerevisiae | 11570 | Cytoplasmic | 11572, 11574, 11576, 11578, 11580, 11582, 11584, 11586 |
| 1 | 130 | NUE_OEX_1 | YML089C | S. cerevisiae | 11597 | Cytoplasmic | — |
| 1 | 131 | NUE_OEX_1 | YML128C | S. cerevisiae | 11601 | Cytoplasmic | 11603, 11605, 11607, 11609 |
| 1 | 132 | NUE_OEX_1 | YMR011W | S. cerevisiae | 11613 | Cytoplasmic | 11615, 11617, 11619, 11621, 11623, 11625, 11627, 11629, 11631, 11633, 11635, 11637, 11639, 11641, 11643, 11645, 11647, 11649, 11651, 11653, 11655, 11657, 11659, 11661, 11663, 11665, 11667, 11669, 11671, 11673, 11675, 11677, 11679, 11681, 11683, 11685, 11687, 11689, 11691, 11693, 11695, 11697, 11699, 11701, 11703, 11705, 11707, 11709, 11711, 11713, 11715, 11717, 11719, 11721, 11723, 11725, 11727, 11729, 11731, 11733, 11735, 11737, 11739, 11741, 11743, 11745, 11747, 11749, 11751, 11753, 11755, 11757, 11759, 11761, 11763, 11765, 11767, 11769, 11771, 11773, 11775, 11777, 11779, 11781, 11783, 11785, 11787, 11789, 11791, 11793, 11795, 11797, 11799, 11801, 11803, 11805, 11807, 11809, 11811, 11813, 11815, 11817, 11819, 11821, 11823, 11825, 11827, 11829, 11831, 11833, 11835, 11837, 11839, 11841, 11843, 11845, 11847, 11849, 11851, 11853, 11855, 11857, 11859, 11861, 11863, 11865, 11867, 11869, 11871, 11873, 11875, 11877, 11879, 11881, 11883, 11885, 11887, 11889, 11891, 11893, 11895, 11897, 11899, 11901, 11903, 11905, 11907, 11909, 11911, 11913, 11915, 11917, 11919, 11921, 11923, 11925, 11927, 11929, 11931, 11933, 11935, 11937, 11939, 11941, 11943, 11945, 11947, 11949, 11951, 11953, 11955, 11957, 11959, 11961, 11963, 11965, 11967, 11969, 11971, 11973, 11975, 11977, 11979, 11981, 11983, 11985, 11987, 11989, 11991, 11993, 11995, 11997, 11999, 12001, 12003, 12005, 12007, 12009, 12011, 12013, 12015, 12017, 12019, 12021, 12023, 12025, 12027, 12029, 12031, 12033, 12035, 12037, 12039, 12041, 12043, 12045, 12047, 12049, 12051, 12053, 12055, 12057, 12059, 12061, 12063, 12065, 12067, 12069, 12071, 12073, 12075, 12077, 12079, 12081, 12083, 12085, 12087, 12089, 12091, 12093, 12095, 12097, 12099, 12101, 12103, 12105, 12107, 12109, 12111, 12113, 12115, 12117, 12119, 12121, 12123 |
| 1 | 133 | NUE_OEX_1 | YMR037C | S. cerevisiae | 12247 | Cytoplasmic | 12249, 12251, 12253, 12255 |
| 1 | 134 | NUE_OEX_1 | YMR049C | S. cerevisiae | 12264 | Cytoplasmic | 12266, 12268, 12270, 12272, 12274, 12276, 12278, 12280, 12282, 12284, 12286, 12288, 12290, 12292, 12294, 12296, 12298 |
| 1 | 135 | NUE_OEX_1 | YMR052W | S. cerevisiae | 12317 | Cytoplasmic | 12319, 12321 |
| 1 | 136 | NUE_OEX_1 | YMR082C | S. cerevisiae | 12328 | Cytoplasmic | — |
| 1 | 137 | NUE_OEX_1 | YMR125W | S. cerevisiae | 12332 | Cytoplasmic | 12334, 12336, 12338, 12340, 12342, 12344, 12346, 12348, 12350, 12352, 12354, 12356, 12358, 12360, 12362, 12364, 12366 |
| 1 | 138 | NUE_OEX_1 | YMR126C | S. cerevisiae | 12379 | Cytoplasmic | 12381, 12383, 12385 |
| 1 | 139 | NUE_OEX_1 | YMR144W | S. cerevisiae | 12395 | Cytoplasmic | 12397, 12399 |
| 1 | 140 | NUE_OEX_1 | YMR160W | S. cerevisiae | 12407 | Cytoplasmic | 12409, 12411 |
| 1 | 141 | NUE_OEX_1 | YMR191W | S. cerevisiae | 12415 | Cytoplasmic | 12417 |
| 1 | 142 | NUE_OEX_1 | YMR209C | S. cerevisiae | 12421 | Cytoplasmic | 12423, 12425, 12427, 12429 |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 143 | NUE_OEX_1 | YMR233W | S. cerevisiae | 12441 | Cytoplasmic | 12443, 12445, 12447, 12449, 12451, 12453, 12455, 12457, 12459, 12461, 12463, 12465 |
| 1 | 144 | NUE_OEX_1 | YMR278W | S. cerevisiae | 12471 | Cytoplasmic | 12473, 12475, 12477, 12479, 12481, 12483, 12485, 12487, 12489, 12491, 12493, 12495, 12497, 12499, 12501, 12503, 12505, 12507, 12509, 12511, 12513, 12515, 12517, 12519, 12521, 12523, 12525, 12527, 12529, 12531, 12533, 12535, 12537, 12539, 12541, 12543, 12545, 12547, 12549, 12551, 12553, 12555, 12557, 12559, 12561, 12563, 12565, 12567, 12569, 12571, 12573, 12575, 12577, 12579, 12581, 12583, 12585, 12587, 12589, 12591, 12593, 12595, 12597, 12599, 12601, 12603, 12605, 12607, 12609, 12611, 12613, 12615, 12617, 12619, 12621, 12623, 12625, 12627, 12629, 12631, 12633, 12635, 12637, 12639, 12641, 12643, 12645, 12647, 12649, 12651, 12653, 12655, 12657, 12659, 12661, 12663, 12665, 12667, 12669, 12671, 12673, 12675, 12677, 12679, 12681, 12683, 12685, 12687, 12689, 12691, 12693, 12695, 12697, 12699, 12701, 12703, 12705, 12707, 12709, 12711, 12713, 12715, 12717, 12719, 12721, 12723, 12725, 12727, 12729, 12731, 12733, 12735, 12737, 12739 |
| 1 | 145 | NUE_OEX_1 | YMR280C | S. cerevisiae | 12750 | Cytoplasmic | 12752, 12754, 12756 |
| 1 | 146 | NUE_OEX_1 | YNL014W | S. cerevisiae | 12774 | Cytoplasmic | 12776, 12778, 12780, 12782, 12784, 12786, 12788, 12790, 12792, 12794, 12796, 12798, 12800, 12802, 12804, 12806, 12808, 12810 |
| 1 | 147 | NUE_OEX_1 | YNL320W | S. cerevisiae | 12830 | Cytoplasmic | 12832, 12834, 12836, 12838, 12840, 12842, 12844, 12846, 12848, 12850, 12852, 12854, 12856, 12858, 12860, 12862, 12864, 12866 |
| 1 | 148 | NUE_OEX_1 | YOL007C | S. cerevisiae | 12884 | Cytoplasmic | 12886 |
| 1 | 149 | NUE_OEX_1 | YOL164W | S. cerevisiae | 12890 | Cytoplasmic | 12892, 12894, 12896, 12898, 12900, 12902, 12904, 12906, 12908, 12910, 12912, 12914, 12916, 12918, 12920, 12922, 12924, 12926, 12928, 12930, 12932, 12934, 12936, 12938, 12940, 12942, 12944, 12946, 12948, 12950, 12952, 12954, 12956, 12958, 12960, 12962, 12964, 12966, 12968, 12970, 12972, 12974, 12976, 12978, 12980, 12982, 12984, 12986, 12988, 12990, 12992, 12994, 12996, 12998, 13000 |
| 1 | 150 | NUE_OEX_1 | YOR076C | S. cerevisiae | 13015 | Cytoplasmic | — |
| 1 | 151 | NUE_OEX_1 | YOR083W | S. cerevisiae | 13019 | Cytoplasmic | 13021 |
| 1 | 152 | NUE_OEX_1 | YOR097C | S. cerevisiae | 13025 | Cytoplasmic | 13027 |
| 1 | 153 | NUE_OEX_1 | YOR128C | S. cerevisiae | 13031 | Cytoplasmic | 13033, 13035, 13037, 13039, 13041, 13043, 13045, 13047, 13049, 13051, 13053, 13055, 13057, 13059, 13061, 13063, 13065, 13067, 13069, 13071, 13073, 13075, 13077, 13079, 13081, 13083, 13085, 13087, 13089, 13091, 13093, 13095, 13097 |
| 1 | 154 | NUE_OEX_1 | YOR353C | S. cerevisiae | 14086 | Cytoplasmic | 14088, 14090 |
| 1 | 155 | NUE_OEX_1 | YPL141C | S. cerevisiae | 14094 | Cytoplasmic | 14096, 14098, 14100 |
| 1 | 156 | NUE_OEX_1 | YPR088C | S. cerevisiae | 14114 | Cytoplasmic | 14116, 14118, 14120, 14122, 14124, 14126, 14128, 14130, 14132, 14134, 14136, 14138, 14140, 14142, 14144, 14146, 14148, 14150, 14152, 14154, 14156, 14158, 14160, 14162, 14164, 14166, 14168, 14170, 14172, 14174, 14176, 14178, 14180, 14182, 14184, 14186, 14188, 14190, 14192, 14194, 14196, 14198, 14200, 14202, 14204, 14206, 14208, 14210, 14212, 14214 |
| 1 | 157 | NUE_OEX_1 | YPR108W | S. cerevisiae | 14247 | Cytoplasmic | 14249, 14251, 14253, 14255, 14257, 14259, 14261, 14263, 14265, 14267, 14269, 14271, 14273, 14275, 14277, 14279, 14281, 14283, 14285, 14287, 14289 |
| 1 | 158 | NUE_OEX_1 | YPR110C | S. cerevisiae | 14312 | Cytoplasmic | 14314, 14316, 14318, 14320, 14322, 14324, 14326, 14328, 14330, 14332, 14334, 14336, 14338, 14340, 14342, 14344, 14346, 14348, 14350, 14352, 14354, 14356, 14358, 14360, 14362, 14364, 14366, 14368, 14370, 14372 |
| 1 | 159 | NUE_OEX_1 | B3825_2 | E. coli | 14915 | Plastidic | 14917, 14919, 14921, 14923, 14925, 14927, 14929, 14931, 14933, 14935, 14937, 14939, 14941, 14943, 14945, 14947, 14949, 14951, 14953, 14955, 14957, 14959, 14961, 14963, 14965, 14967, 14969, 14971, 14973, 14975, 14977, 14979, 14981, 14983, 14985, 14987, 14989, 14991, 14993, 14995, 14997, 14999, 15001, 15003, 15005, 15007, 15009 |
| 1 | 160 | NUE_OEX_1 | YIR034C_2 | S. cerevisiae | 15383 | Cytoplasmic | 15385, 15387, 15389, 15391, 15393, 15395, 15397, 15399, 15401, 15403, 15405, 15407, 15409, 15411, 15413, 15415, 15417, 15419 |
| 1 | 161 | NUE_OEX_1 | YJR131W_2 | S. cerevisiae | 15461 | Cytoplasmic | 15463, 15465, 15467, 15469, 15471, 15473, 15475, 15477, 15479, 15481, 15483, 15485, 15487, 15489, 15491, 15493, 15495, 15497, 15499, 15501, 15503, 15505, 15507, 15509, 15511, 15513, 15515, 15517, 15519, 15521, 15523, 15525, 15527, 15529, 15531, 15533, 15535, 15537, 15539, 15541, 15543, 15545, 15547, 15549, 15551, 15553, 15555 |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 162 | NUE_OEX_1 | YKL100C_2 | S. cerevisiae | 15572 | Cytoplasmic | 15574, 15576, 15578, 15580 |
| 1 | 163 | NUE_OEX_1 | YKL193C_2 | S. cerevisiae | 15594 | Cytoplasmic | 15596, 15598, 15600, 15602, 15604, 15606, 15608, 15610, 15612, 15614, 15616, 15618, 15620, 15622, 15624, 15626, 15628, 15630 |
| 1 | 164 | NUE_OEX_1 | YLL016W_2 | S. cerevisiae | 15647 | Cytoplasmic | 15649, 15651, 15653, 15655, 15657, 15659, 15661 |
| 1 | 165 | NUE_OEX_1 | YLR034C_2 | S. cerevisiae | 15674 | Cytoplasmic | 15676, 15678, 15680, 15682, 15684, 15686, 15688, 15690, 15692, 15694, 15696, 15698, 15700, 15702, 15704, 15706, 15708, 15710, 15712, 15714, 15716, 15718, 15720, 15722, 15724, 15726, 15728, 15730, 15732, 15734, 15736, 15738, 15740, 15742, 15744, 15746, 15748, 15750, 15752, 15754, 15756, 15758, 15760, 15762, 15764, 15766, 15768, 15770, 15772, 15774, 15776, 15778, 15780, 15782, 15784, 15786, 15788, 15790, 15792, 15794, 15796, 15798, 15800, 15802, 15804, 15806, 15808, 15810, 15812, 15814, 15816, 15818, 15820, 15822, 15824, 15826, 15828, 15830, 15832, 15834, 15836, 15838, 15840, 15842, 15844, 15846, 15848, 15850, 15852, 15854, 15856, 15858, 15860, 15862, 15864, 15866, 15868, 15870, 15872, 15874, 15876, 15878, 15880, 15882, 15884, 15886, 15888, 15890, 15892, 15894, 15896, 15898, 15900, 15902, 15904, 15906, 15908, 15910, 15912, 15914, 15916, 15918, 15920, 15922, 15924, 15926, 15928, 15930, 15932, 15934, 15936, 15938, 15940, 15942, 15944, 15946, 15948, 15950, 15952, 15954, 15956, 15958, 15960, 15962, 15964, 15966, 15968, 15970, 15972, 15974, 15976 |
| 1 | 166 | NUE_OEX_1 | YLR060W_2 | S. cerevisiae | 16006 | Cytoplasmic | 16008, 16010, 16012, 16014, 16016, 16018, 16020, 16022, 16024, 16026, 16028, 16030, 16032, 16034, 16036, 16038, 16040, 16042, 16044, 16046, 16048, 16050, 16052, 16054, 16056, 16058, 16060, 16062, 16064, 16066, 16068, 16070, 16072, 16074, 16076, 16078, 16080, 16082, 16084 |
| 1 | 167 | NUE_OEX_1 | YMR082C_2 | S. cerevisiae | 16115 | Cytoplasmic | 16117 |
| 1 | 168 | NUE_OEX_1 | B1258 | E. coli | 14403 | Cytoplasmic | 14405, 14407, 14409, 14411, 14413, 14415, 14417, 14419, 14421, 14423, 14425, 14427, 14429, 14431, 14433, 14435, 14437, 14439, 14441, 14443, 14445, 14447, 14449, 14451, 14453, 14455, 14457, 14459, 14461, 14463, 14465, 14467, 14469, 14471, 14473, 14475, 14477, 14479, 14481, 14483, 14485, 14487, 14489, 14491 |
| 1 | 169 | NUE_OEX_1 | YML101C | S. cerevisiae | 16094 | Cytoplasmic | 16096, 16098, 16100 |
| 1 | 170 | NUE_OEX_1 | YMR065W | S. cerevisiae | 16107 | Cytoplasmic | 16109, 16111 |
| 1 | 171 | NUE_OEX_1 | YMR163C | S. cerevisiae | 16121 | Cytoplasmic | 16123, 16125, 16127 |
| 1 | 172 | NUE_OEX_1 | YOL042W | S. cerevisiae | 16276 | Cytoplasmic | 16278, 16280, 16282, 16284, 16286, 16288 |
| 1 | 173 | NUE_OEX_1 | YOR226C | S. cerevisiae | 16306 | Cytoplasmic | 16308, 16310, 16312, 16314, 16316, 16318, 16320, 16322, 16324, 16326, 16328, 16330, 16332, 16334, 16336, 16338, 16340, 16342, 16344, 16346, 16348, 16350, 16352, 16354, 16356, 16358, 16360, 16362, 16364, 16366, 16368, 16370, 16372, 16374, 16376, 16378, 16380, 16382, 16384, 16386, 16388, 16390, 16392, 16394, 16396, 16398, 16400, 16402, 16404, 16406, 16408, 16410, 16412, 16414, 16416, 16418, 16420, 16422, 16424, 16426, 16428, 16430, 16432, 16434, 16436, 16438, 16440, 16442, 16444, 16446, 16448, 16450, 16452, 16454, 16456, 16458, 16460, 16462, 16464, 16466, 16468, 16470, 16472, 16474, 16476, 16478, 16480, 16482, 16484, 16486, 16488, 16490, 16492, 16494, 16496, 16498, 16500, 16502, 16504, 16506, 16508, 16510, 16512, 16514, 16516, 16518, 16520, 16522, 16524, 16526, 16528, 16530, 16532, 16534, 16536 |
| 1 | 174 | NUE_OEX_1 | YPL068C | S. cerevisiae | 16574 | Cytoplasmic | 16576, 16578 |
| 1 | 175 | NUE_OEX_1 | B0165 | E. coli | 14397 | Plastidic | 14399 |
| 1 | 176 | NUE_OEX_1 | YOR203W | S. cerevisiae | 16300 | Cytoplasmic | 16302 |
| 1 | 177 | NUE_OEX_1 | YNL147W | S. cerevisiae | 16134 | Cytoplasmic | 16136, 16138, 16140, 16142, 16144, 16146, 16148, 16150, 16152, 16154, 16156, 16158, 16160, 16162, 16164, 16166, 16168, 16170, 16172, 16174, 16176, 16178, 16180, 16182, 16184, 16186, 16188, 16190, 16192, 16194, 16196, 16198, 16200, 16202, 16204, 16206, 16208, 16210, 16212, 16214, 16216, 16218, 16220, 16222, 16224, 16226, 16228, 16230, 16232, 16234, 16236, 16238, 16240, 16242, 16244, 16246, 16248, 16250, 16252, 16254, 16256 |
| 1 | 178 | NUE_OEX_1 | YBR083W | S. cerevisiae | 15057 | Cytoplasmic | 15059, 15061 |
| 1 | 179 | NUE_OEX_1 | YKL111C | S. cerevisiae | 15588 | Cytoplasmic | 15590 |
| 1 | 180 | NUE_OEX_1 | YPR067W | S. cerevisiae | 16583 | Cytoplasmic | 16585, 16587, 16589, 16591, 16593, 16595, 16597, 16599, 16601, 16603, 16605, 16607, 16609, 16611, 16613, 16615, 16617, 16619, 16621, 16623 |
| 1 | 181 | NUE_OEX_1 | B1985 | E. coli | 14840 | Cytoplasmic | 14842, 14844, 14846, 14848, 14850, 14852, 14854, 14856, 14858, 14860, 14862, 14864, 14866 |

TABLE IIA-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 182 | NUE_OEX_1 | B3838 | E. coli | 15015 | Cytoplasmic | 15017, 15019, 15021, 15023, 15025, 15027, 15029, 15031, 15033, 15035, 15037, 15039, 15041, 15043, 15045, 15047, 15049 |
| 1 | 183 | NUE_OEX_1 | YJL010C | S. cerevisiae | 15433 | Cytoplasmic | 15435, 15437, 15439, 15441, 15443, 15445, 15447, 15449 |
| 1 | 184 | NUE_OEX_1 | B1267 | E. coli | 14498 | Cytoplasmic | 14500, 14502, 14504, 14506, 14508, 14510, 14512, 14514, 14516, 14518, 14520, 14522, 14524, 14526, 14528, 14530, 14532, 14534, 14536, 14538, 14540, 14542, 14544, 14546, 14548, 14550, 14552, 14554, 14556, 14558, 14560, 14562, 14564, 14566, 14568, 14570, 14572, 14574, 14576, 14578, 14580, 14582, 14584, 14586, 14588, 14590, 14592, 14594, 14596, 14598, 14600, 14602, 14604, 14606, 14608, 14610, 14612, 14614, 14616, 14618, 14620, 14622, 14624, 14626, 14628, 14630, 14632, 14634, 14636, 14638, 14640, 14642, 14644, 14646, 14648, 14650, 14652, 14654, 14656, 14658, 14660, 14662, 14664, 14666, 14668, 14670, 14672, 14674, 14676, 14678, 14680, 14682, 14684, 14686, 14688, 14690, 14692, 14694, 14696, 14698, 14700, 14702, 14704, 14706, 14708 |
| 1 | 185 | NUE_OEX_1 | B1322 | E. coli | 14719 | Cytoplasmic | 14721, 14723, 14725, 14727, 14729, 14731, 14733, 14735, 14737, 14739, 14741, 14743, 14745, 14747, 14749, 14751, 14753, 14755, 14757, 14759, 14761, 14763, 14765, 14767, 14769, 14771, 14773, 14775, 14777, 14779, 14781, 14783, 14785 |
| 1 | 186 | NUE_OEX_1 | B1381 | E. coli | 14792 | Cytoplasmic | 14794, 14796, 14798, 14800, 14802, 14804, 14806, 14808, 14810, 14812, 14814, 14816, 14818, 14820 |
| 1 | 187 | NUE_OEX_1 | B2646 | E. coli | 14880 | Cytoplasmic | 14882, 14884, 14886, 14888, 14890, 14892, 14894, 14896, 14898, 14900, 14902, 14904, 14906, 14908 |
| 1 | 188 | NUE_OEX_1 | YBR191W | S. cerevisiae | 15065 | Cytoplasmic | 15067, 15069, 15071, 15073, 15075, 15077, 15079, 15081, 15083, 15085, 15087, 15089, 15091, 15093, 15095, 15097, 15099, 15101, 15103, 15105, 15107, 15109, 15111, 15113, 15115, 15117, 15119, 15121, 15123, 15125, 15127, 15129, 15131, 15133, 15135, 15137, 15139, 15141, 15143, 15145, 15147, 15149, 15151, 15153, 15155, 15157, 15159, 15161, 15163, 15165, 15167, 15169, 15171, 15173, 15175, 15177, 15179, 15181, 15183, 15185, 15187, 15189, 15191, 15193, 15195, 15197, 15199, 15201, 15203, 15205, 15207, 15209, 15211, 15213, 15215, 15217 |
| 1 | 189 | NUE_OEX_1 | YDL135C | S. cerevisiae | 15258 | Cytoplasmic | 15260, 15262, 15264, 15266, 15268, 15270, 15272, 15274, 15276, 15278, 15280, 15282, 15284, 15286, 15288, 15290, 15292, 15294, 15296, 15298, 15300, 15302, 15304, 15306, 15308, 15310, 15312, 15314, 15316, 15318, 15320, 15322, 15324, 15326, 15328, 15330, 15332, 15334, 15336, 15338, 15340, 15342, 15344, 15346, 15348, 15350, 15352, 15354, 15356 |
| 1 | 190 | NUE_OEX_1 | YHL005C | S. cerevisiae | 15379 | Cytoplasmic | — |
| 1 | 191 | NUE_OEX_1 | YKR100C_2 | S. cerevisiae | 16630 | Cytoplasmic | 16632, 16634, 16636, 16638 |
| 1 | 192 | NUE_OEX_1 | YMR191W_2 | S. cerevisiae | 16648 | Cytoplasmic | 16650, 16652 |

TABLE IIA_CHOM

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 1 | NUE_OEX_1 | yor128c CHOM | S. cerevisiae | 13031 | Cytoplasmic | 13118, 13120, 13122, 13124, 13126, 13128, 13130, 13132, 13134, 13136, 13138, 13140, 13142, 13144, 13146, 13148, 13150, 13152, 13154, 13156, 13158, 13160, 13162, 13164, 13166, 13168, 13170, 13172, 13174, 13176, 13178, 13180, 13182, 13184, 13186, 13188, 13190, 13192, 13194, 13196, 13198, 13200, 13202, 13204, 13206, 13208, 13210, 13212, 13214, 13216, 13218, 13220, 13222, 13224, 13226, 13228, 13230, 13232, 13234, 13236, 13238, 13240, 13242, 13244, 13246, 13248, 13250, 13252, 13254, 13256, 13258, 13260, 13262, 13264, 13266, 13268, 13270, 13272, 13274, 13276, 13278, 13280, 13282, 13284, 13286, 13288, 13290, 13292, 13294, 13296, 13298, 13300, 13302, 13304, 13306, 13308, 13310, 13312, 13314, 13316, 13318, 13320, 13322, 13324, 13326, 13328, 13330, 13332, 13334, 13336, 13338, 13340, |

TABLE IIA__CHOM-continued

| | | | | 5. | | |
|---|---|---|---|---|---|---|
| Appli-cation | 1. Hit | 2. Project | 3. Locus | 4. Organism | Lead SEQ ID | 6. Target | 7. SEQ IDs of Polypeptide Homologs |

13342, 13344, 13346, 13348, 13350, 13352, 13354, 13356, 13358, 13360, 13362, 13364, 13366, 13368, 13370, 13372, 13374, 13376, 13378, 13380, 13382, 13384, 13386, 13388, 13390, 13392, 13394, 13396, 13398, 13400, 13402, 13404, 13406, 13408, 13410, 13412, 13414, 13416, 13418, 13420, 13422, 13424, 13426, 13428, 13430, 13432, 13434, 13436, 13438, 13440, 13442, 13444, 13446, 13448, 13450, 13452, 13454, 13456, 13458, 13460, 13462, 13464, 13466, 13468, 13470, 13472, 13474, 13476, 13478, 13480, 13482, 13484, 13486, 13488, 13490, 13492, 13494, 13496, 13498, 13500, 13502, 13504, 13506, 13508, 13510, 13512, 13514, 13516, 13518, 13520, 13522, 13524, 13526, 13528, 13530, 13532, 13534, 13536, 13538, 13540, 13542, 13544, 13546, 13548, 13550, 13552, 13554, 13556, 13558, 13560, 13562, 13564, 13566, 13568, 13570, 13572, 13574, 13576, 13578, 13580, 13582, 13584, 13586, 13588, 13590, 13592, 13594, 13596, 13598, 13600, 13602, 13604, 13606, 13608, 13610, 13612, 13614, 13616

TABLE IIA__NHOM

Amino acid sequence ID numbers

| Appli-cation | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 1 | NUE_OEX_1 | yor128c NHOM | S. cerevisiae | 13031 | Cytoplasmic | 13625, 13627, 13629, 13631, 13633, 13635, 13637, 13639, 13641, 13643, 13645, 13647, 13649, 13651, 13653, 13655, 13657, 13659, 13661, 13663, 13665, 13667, 13669, 13671, 13673, 13675, 13677, 13679, 13681, 13683, 13685, 13687, 13689, 13691, 13693, 13695, 13697, 13699, 13701, 13703, 13705, 13707, 13709, 13711, 13713, 13715, 13717, 13719, 13721, 13723, 13725, 13727, 13729, 13731, 13733, 13735, 13737, 13739, 13741, 13743, 13745, 13747, 13749, 13751, 13753, 13755, 13757, 13759, 13761, 13763, 13765, 13767, 13769, 13771, 13773, 13775, 13777, 13779, 13781, 13783, 13785, 13787, 13789, 13791, 13793, 13795, 13797, 13799, 13801, 13803, 13805, 13807, 13809, 13811, 13813, 13815, 13817, 13819, 13821, 13823, 13825, 13827, 13829, 13831, 13833, 13835, 13837, 13839, 13841, 13843, 13845, 13847, 13849, 13851, 13853, 13855, 13857, 13859, 13861, 13863, 13865, 13867, 13869, 13871, 13873, 13875, 13877, 13879, 13881, 13883, 13885, 13887, 13889, 13891, 13893, 13895, 13897, 13899, 13901, 13903, 13905, 13907, 13909, 13911, 13913, 13915, 13917, 13919, 13921, 13923, 13925, 13927, 13929, 13931, 13933, 13935, 13937, 13939, 13941, 13943, 13945, 13947, 13949, 13951, 13953, 13955, 13957, 13959, 13961, 13963, 13965, 13967, 13969, 13971, 13973, 13975, 13977, 13979, 13981, 13983, 13985, 13987, 13989, 13991, 13993, 13995, 13997, 13999, 14001, 14003, 14005, 14007, 14009, 14011, 14013, 14015, 14017, 14019, 14021, 14023, 14025, 14027, 14029, 14031, 14033, 14035, 14037, 14039, 14041, 14043, 14045, 14047, 14049, 14051, 14053, 14055, 14057, 14059, 14061, 14063, 14065, 14067, 14069, 14071, 14073, 14075, 14077, 14079, 14081 |

TABLE IIB

Amino acid sequence ID numbers

| Appli-cation | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 1 | NUE_OEX_1 | B0017 | E. coli | 39 | Cytoplasmic | — |
| 1 | 2 | NUE_OEX_1 | B0045 | E. coli | 43 | Cytoplasmic | 99, 101, 103, 105, 107, 109, 111, 113, 115, 117 |
| 1 | 3 | NUE_OEX_1 | B0180 | E. coli | 124 | Plastidic | 366, 368, 370, 372, 374 |
| 1 | 4 | NUE_OEX_1 | B0242 | E. coli | 381 | Plastidic | 663, 665, 667, 669 |

TABLE IIB-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 5 | NUE_OEX_1 | B0403 | *E. coli* | 680 | Plastidic | — |
| 1 | 6 | NUE_OEX_1 | B0474 | *E. coli* | 813 | Cytoplasmic | 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 16658 |
| 1 | 7 | NUE_OEX_1 | B0754 | *E. coli* | 1056 | Plastidic | — |
| 1 | 8 | NUE_OEX_1 | B0784 | *E. coli* | 1564 | Cytoplasmic | — |
| 1 | 9 | NUE_OEX_1 | B0873 | *E. coli* | 1706 | Plastidic | — |
| 1 | 10 | NUE_OEX_1 | B1014 | *E. coli* | 1845 | Cytoplasmic | — |
| 1 | 11 | NUE_OEX_1 | B1020 | *E. coli* | 1951 | Plastidic | — |
| 1 | 12 | NUE_OEX_1 | B1180 | *E. coli* | 1976 | Cytoplasmic | 2100, 2102, 2104, 2106, 2108, 2110, 2112, 2114, 2116, 2118, 2120, 16662 |
| 1 | 13 | NUE_OEX_1 | B1933 | *E. coli* | 2128 | Plastidic | — |
| 1 | 14 | NUE_OEX_1 | B2032 | *E. coli* | 2136 | Plastidic | — |
| 1 | 15 | NUE_OEX_1 | B2165 | *E. coli* | 2172 | Plastidic | 2286, 2288 |
| 1 | 16 | NUE_OEX_1 | B2223 | *E. coli* | 2298 | Plastidic | — |
| 1 | 17 | NUE_OEX_1 | B2238 | *E. coli* | 2427 | Plastidic | — |
| 1 | 17 | NUE_OEX_1 | B2238 | *E. coli* | 2427 | Cytoplasmic | — |
| 1 | 18 | NUE_OEX_1 | B2310 | *E. coli* | 2453 | Plastidic | — |
| 1 | 19 | NUE_OEX_1 | B2431 | *E. coli* | 2552 | Plastidic | — |
| 1 | 20 | NUE_OEX_1 | B2600 | *E. coli* | 2601 | Plastidic | — |
| 1 | 21 | NUE_OEX_1 | B2766 | *E. coli* | 2669 | Plastidic | — |
| 1 | 22 | NUE_OEX_1 | B2903 | *E. coli* | 2773 | Cytoplasmic | 3097, 3099 |
| 1 | 23 | NUE_OEX_1 | B3117 | *E. coli* | 3118 | Plastidic | 3374, 3376, 3378, 3380, 3382 |
| 1 | 24 | NUE_OEX_1 | B3120 | *E. coli* | 3391 | Plastidic | — |
| 1 | 25 | NUE_OEX_1 | B3216 | *E. coli* | 3397 | Plastidic | — |
| 1 | 26 | NUE_OEX_1 | B3451 | *E. coli* | 3471 | Plastidic | — |
| 1 | 27 | NUE_OEX_1 | B3791 | *E. coli* | 3564 | Cytoplasmic | — |
| 1 | 28 | NUE_OEX_1 | B3825 | *E. coli* | 3771 | Plastidic | — |
| 1 | 29 | NUE_OEX_1 | YAL019W | *S. cerevisiae* | 3869 | Cytoplasmic | — |
| 1 | 30 | NUE_OEX_1 | YAR035W | *S. cerevisiae* | 3896 | Cytoplasmic | — |
| 1 | 31 | NUE_OEX_1 | YBL021C | *S. cerevisiae* | 3954 | Cytoplasmic | 4032, 4034, 4036, 4038, 4040, 4042, 4044, 4046, 4048, 4050, 4052, 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106 |
| 1 | 32 | NUE_OEX_1 | YBR055C | *S. cerevisiae* | 4112 | Cytoplasmic | — |
| 1 | 33 | NUE_OEX_1 | YBR128C | *S. cerevisiae* | 4150 | Cytoplasmic | — |
| 1 | 34 | NUE_OEX_1 | YBR159W | *S. cerevisiae* | 4163 | Cytoplasmic | 4215, 4217, 4219, 4221, 4223, 4225, 4227 |
| 1 | 35 | NUE_OEX_1 | YBR243C | *S. cerevisiae* | 4236 | Cytoplasmic | 4268, 4270 |
| 1 | 35 | NUE_OEX_1 | YBR243C | *S. cerevisiae* | 4236 | Plastidic | 4268, 4270 |
| 1 | 36 | NUE_OEX_1 | YBR262C | *S. cerevisiae* | 4281 | Cytoplasmic | — |
| 1 | 37 | NUE_OEX_1 | YCR019W | *S. cerevisiae* | 4289 | Cytoplasmic | — |
| 1 | 38 | NUE_OEX_1 | YDR070C | *S. cerevisiae* | 4316 | Cytoplasmic | — |
| 1 | 39 | NUE_OEX_1 | YDR079W | *S. cerevisiae* | 4326 | Cytoplasmic | — |
| 1 | 40 | NUE_OEX_1 | YDR123C | *S. cerevisiae* | 4336 | Cytoplasmic | — |
| 1 | 41 | NUE_OEX_1 | YDR137W | *S. cerevisiae* | 4347 | Cytoplasmic | — |
| 1 | 42 | NUE_OEX_1 | YDR294C | *S. cerevisiae* | 4362 | Cytoplasmic | — |
| 1 | 42 | NUE_OEX_1 | YDR294C | *S. cerevisiae* | 4362 | Plastidic | — |
| 1 | 43 | NUE_OEX_1 | YDR330W | *S. cerevisiae* | 4403 | Cytoplasmic | — |
| 1 | 44 | NUE_OEX_1 | YDR355C | *S. cerevisiae* | 4432 | Cytoplasmic | — |
| 1 | 45 | NUE_OEX_1 | YDR430C | *S. cerevisiae* | 4436 | Plastidic | — |
| 1 | 46 | NUE_OEX_1 | YDR472W | *S. cerevisiae* | 4486 | Cytoplasmic | — |
| 1 | 47 | NUE_OEX_1 | YDR497C | *S. cerevisiae* | 4507 | Plastidic | 4739, 4741, 4743, 4745, 4747, 4749, 4751, 4753, 4755, 4757, 4759, 4761, 4763, 4765, 4767, 4769, 4771, 4773, 4775, 4777, 4779, 4781, 4783, 4785, 16666 |
| 1 | 48 | NUE_OEX_1 | YER029C | *S. cerevisiae* | 4791 | Cytoplasmic | — |
| 1 | 49 | NUE_OEX_1 | YFR007W | *S. cerevisiae* | 4807 | Cytoplasmic | — |
| 1 | 50 | NUE_OEX_1 | YGL039W | *S. cerevisiae* | 4837 | Cytoplasmic | 5215, 5217, 5219, 5221, 5223, 5225, 5227, 5229, 5231, 5233, 5235, 5237, 5239, 5241, 5243, 5245, 5247, 5249, 5251, 5253, 5255, 5257, 5259, 5261, 5263, 5265, 5267, 5269, 5271, 5273, 5275, 5277, 5279, 5281, 5283, 5285, 5287, 5289, 5291, 5293, 5295, 5297, 5299, 5301, 5303, 5305 |
| 1 | 51 | NUE_OEX_1 | YGL043W | *S. cerevisiae* | 5312 | Cytoplasmic | 5336, 5338, 5340 |
| 1 | 52 | NUE_OEX_1 | YGR088W | *S. cerevisiae* | 5347 | Cytoplasmic | 5525 |
| 1 | 53 | NUE_OEX_1 | YGR122C-A | *S. cerevisiae* | 5534 | Cytoplasmic | — |
| 1 | 54 | NUE_OEX_1 | YGR142W | *S. cerevisiae* | 5552 | Cytoplasmic | — |
| 1 | 55 | NUE_OEX_1 | YGR143W | *S. cerevisiae* | 5560 | Cytoplasmic | — |
| 1 | 56 | NUE_OEX_1 | YGR165W | *S. cerevisiae* | 5603 | Cytoplasmic | — |
| 1 | 57 | NUE_OEX_1 | YGR170W | *S. cerevisiae* | 5609 | Cytoplasmic | — |
| 1 | 58 | NUE_OEX_1 | YGR202C | *S. cerevisiae* | 5615 | Cytoplasmic | — |
| 1 | 59 | NUE_OEX_1 | YGR266W | *S. cerevisiae* | 5667 | Cytoplasmic | — |
| 1 | 60 | NUE_OEX_1 | YGR282C | *S. cerevisiae* | 5702 | Cytoplasmic | — |
| 1 | 61 | NUE_OEX_1 | YGR290W | *S. cerevisiae* | 5751 | Cytoplasmic | — |

TABLE IIB-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 62 | NUE_OEX_1 | YHL021C | S. cerevisiae | 5755 | Cytoplasmic | — |
| 1 | 63 | NUE_OEX_1 | YHL031C | S. cerevisiae | 5779 | Cytoplasmic | — |
| 1 | 64 | NUE_OEX_1 | YHR011W | S. cerevisiae | 5813 | Cytoplasmic | 5955, 5957, 5959, 16670 |
| 1 | 65 | NUE_OEX_1 | YHR127W | S. cerevisiae | 5968 | Cytoplasmic | — |
| 1 | 66 | NUE_OEX_1 | YHR137W | S. cerevisiae | 5974 | Cytoplasmic | — |
| 1 | 66 | NUE_OEX_1 | YHR137W | S. cerevisiae | 5974 | Plastidic | — |
| 1 | 67 | NUE_OEX_1 | YIL099W | S. cerevisiae | 6028 | Cytoplasmic | — |
| 1 | 67 | NUE_OEX_1 | YIL099W | S. cerevisiae | 6028 | Plastidic | — |
| 1 | 68 | NUE_OEX_1 | YIL147C | S. cerevisiae | 6108 | Cytoplasmic | — |
| 1 | 69 | NUE_OEX_1 | YIR034C | S. cerevisiae | 6151 | Cytoplasmic | — |
| 1 | 70 | NUE_OEX_1 | YJL013C | S. cerevisiae | 6199 | Cytoplasmic | — |
| 1 | 71 | NUE_OEX_1 | YJL041W | S. cerevisiae | 6209 | Cytoplasmic | — |
| 1 | 72 | NUE_OEX_1 | YJL064W | S. cerevisiae | 6243 | Cytoplasmic | — |
| 1 | 73 | NUE_OEX_1 | YJL067W | S. cerevisiae | 6247 | Cytoplasmic | — |
| 1 | 74 | NUE_OEX_1 | YJL094C | S. cerevisiae | 6251 | Cytoplasmic | — |
| 1 | 75 | NUE_OEX_1 | YJL171C | S. cerevisiae | 6298 | Cytoplasmic | — |
| 1 | 76 | NUE_OEX_1 | YJL213W | S. cerevisiae | 6327 | Cytoplasmic | — |
| 1 | 77 | NUE_OEX_1 | YJR017C | S. cerevisiae | 6489 | Cytoplasmic | 6543 |
| 1 | 78 | NUE_OEX_1 | YJR058C | S. cerevisiae | 6551 | Cytoplasmic | 6663, 6665, 6667, 6669, 6671, 6673, 6675, 6677, 6679, 6681, 6683, 6685, 6687, 6689, 6691, 6693, 6695, 16674, 16676 |
| 1 | 79 | NUE_OEX_1 | YJR117W | S. cerevisiae | 6701 | Cytoplasmic | 6791, 6793, 6795, 6797, 6799, 6801, 6803, 6805, 6807 |
| 1 | 80 | NUE_OEX_1 | YJR121W | S. cerevisiae | 6817 | Cytoplasmic | 7337, 7339, 7341, 7343, 7345, 7347, 7349 |
| 1 | 81 | NUE_OEX_1 | YJR131W | S. cerevisiae | 7367 | Cytoplasmic | 7461, 7463, 7465, 7467 |
| 1 | 82 | NUE_OEX_1 | YJR145C | S. cerevisiae | 7476 | Cytoplasmic | 7560, 7562, 7564, 7566, 7568, 7570, 7572, 7574, 7576, 7578, 7580, 7582, 7584, 7586, 7588, 7590, 7592, 7594, 7596, 16680 |
| 1 | 83 | NUE_OEX_1 | YKL084W | S. cerevisiae | 7603 | Cytoplasmic | — |
| 1 | 84 | NUE_OEX_1 | YKL088W | S. cerevisiae | 7652 | Cytoplasmic | — |
| 1 | 85 | NUE_OEX_1 | YKL100C | S. cerevisiae | 7662 | Cytoplasmic | — |
| 1 | 86 | NUE_OEX_1 | YKL131W | S. cerevisiae | 7676 | Cytoplasmic | — |
| 1 | 87 | NUE_OEX_1 | YKL138C | S. cerevisiae | 7680 | Cytoplasmic | — |
| 1 | 88 | NUE_OEX_1 | YKL178C | S. cerevisiae | 7711 | Cytoplasmic | — |
| 1 | 89 | NUE_OEX_1 | YKL179C | S. cerevisiae | 7736 | Cytoplasmic | — |
| 1 | 90 | NUE_OEX_1 | YKL193C | S. cerevisiae | 7779 | Cytoplasmic | 7815, 7817, 7819, 7821 |
| 1 | 91 | NUE_OEX_1 | YKL216W | S. cerevisiae | 7830 | Cytoplasmic | — |
| 1 | 92 | NUE_OEX_1 | YKR016W | S. cerevisiae | 8018 | Cytoplasmic | — |
| 1 | 93 | NUE_OEX_1 | YKR021W | S. cerevisiae | 8046 | Cytoplasmic | — |
| 1 | 94 | NUE_OEX_1 | YKR055W | S. cerevisiae | 8074 | Cytoplasmic | 8258 |
| 1 | 95 | NUE_OEX_1 | YKR088C | S. cerevisiae | 8264 | Plastidic | — |
| 1 | 96 | NUE_OEX_1 | YKR093W | S. cerevisiae | 8288 | Cytoplasmic | 8444, 8446, 8448, 8450, 8452, 8454, 8456, 8458, 8460, 8462 |
| 1 | 97 | NUE_OEX_1 | YKR099W | S. cerevisiae | 8469 | Cytoplasmic | — |
| 1 | 98 | NUE_OEX_1 | YKR100C | S. cerevisiae | 8485 | Cytoplasmic | — |
| 1 | 99 | NUE_OEX_1 | YLL014W | S. cerevisiae | 8493 | Cytoplasmic | — |
| 1 | 100 | NUE_OEX_1 | YLL016W | S. cerevisiae | 8515 | Cytoplasmic | — |
| 1 | 101 | NUE_OEX_1 | YLL023C | S. cerevisiae | 8540 | Cytoplasmic | — |
| 1 | 102 | NUE_OEX_1 | YLL037W | S. cerevisiae | 8572 | Cytoplasmic | — |
| 1 | 103 | NUE_OEX_1 | YLL049W | S. cerevisiae | 8576 | Cytoplasmic | — |
| 1 | 104 | NUE_OEX_1 | YLL055W | S. cerevisiae | 8580 | Cytoplasmic | — |
| 1 | 105 | NUE_OEX_1 | YLR034C | S. cerevisiae | 8662 | Cytoplasmic | 8964, 8966, 8968, 8970, 8972, 8974, 8976, 8978, 8980, 8982 |
| 1 | 106 | NUE_OEX_1 | YLR042C | S. cerevisiae | 8992 | Cytoplasmic | — |
| 1 | 107 | NUE_OEX_1 | YLR053C | S. cerevisiae | 8996 | Cytoplasmic | — |
| 1 | 108 | NUE_OEX_1 | YLR058C | S. cerevisiae | 9000 | Cytoplasmic | 9502, 9504, 9506, 9508, 9510, 9512, 9514, 9516, 9518, 9520, 9522, 9524, 9526, 9528, 9530, 9532, 9534, 9536, 9538, 9540 |
| 1 | 109 | NUE_OEX_1 | YLR060W | S. cerevisiae | 9552 | Cytoplasmic | — |
| 1 | 110 | NUE_OEX_1 | YLR065C | S. cerevisiae | 9638 | Cytoplasmic | — |
| 1 | 111 | NUE_OEX_1 | YLR070C | S. cerevisiae | 9673 | Cytoplasmic | 10119, 10121, 10123, 10125, 10127, 10129, 10131, 10133, 10135, 10137, 10139, 10141, 10143, 10145, 10147, 10149, 10151, 10153, 10155, 10157, 10159, 10161, 10163, 10165, 10167, 10169, 10171, 10173, 10175, 10177 |
| 1 | 112 | NUE_OEX_1 | YLR100W | S. cerevisiae | 10183 | Cytoplasmic | — |
| 1 | 113 | NUE_OEX_1 | YLR109W | S. cerevisiae | 10215 | Cytoplasmic | 10419, 10421, 10423, 10425, 10427, 10429, 10431, 10433, 10435, 10437, 10439, 10441, 10443 |
| 1 | 114 | NUE_OEX_1 | YLR125W | S. cerevisiae | 10448 | Cytoplasmic | — |
| 1 | 115 | NUE_OEX_1 | YLR127C | S. cerevisiae | 10452 | Cytoplasmic | — |
| 1 | 116 | NUE_OEX_1 | YLR185W | S. cerevisiae | 10464 | Cytoplasmic | 10514, 10516, 10518, 10520, 10522, 10524, 10526 |
| 1 | 117 | NUE_OEX_1 | YLR204W | S. cerevisiae | 10534 | Cytoplasmic | — |
| 1 | 117 | NUE_OEX_1 | YLR204W | S. cerevisiae | 10534 | Plastidic | — |
| 1 | 118 | NUE_OEX_1 | YLR242C | S. cerevisiae | 10542 | Cytoplasmic | — |
| 1 | 119 | NUE_OEX_1 | YLR293C | S. cerevisiae | 10563 | Cytoplasmic | 10715, 10717, 10719, 10721, 10723, 10725, 10727, 10729, 10731, 10733, 10735, 10737, 10739, 10741, 10743, 10745, 10747, 10749, 10751, 10753, 10755, 10757, 10759, 10761, 10763, 10765, 10767, 10769, 10771, 10773, 10775, 10777, 10779, 10781, 10783, 10785, 10787, 10789, 10791, 10793, 10795, 10797, 10799, 10801, 10803, 10805, 10807, 10809, |

TABLE IIB-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| | | | | | | | 10811, 10813, 10815, 10817, 10819, 10821, 10823, 10825, 10827, 10829, 10831, 10833, 10835, 10837, 10839, 10841, 10843, 10845, 10847, 10849, 10851, 10853, 10855, 10857, 10859, 10861, 10863, 10865, 10867, 10869, 10871, 10873, 10875, 10877, 10879, 10881, 10883, 10885, 10887, 10889, 10891, 10893, 10895, 10897, 10899, 10901, 10903, 10905, 10907, 10909, 10911, 10913, 10915, 10917, 10919, 10921, 10923, 10925, 10927, 10929, 10931, 10933, 10935, 10937, 10939, 10941, 10943, 10945, 10947, 10949, 10951, 10953, 10955, 10957, 10959, 10961, 10963, 10965, 10967, 10969, 10971, 10973, 10975, 10977, 10979, 10981, 10983 |
| 1 | 120 | NUE_OEX_1 | YLR313C | S. cerevisiae | 10991 | Cytoplasmic | — |
| 1 | 121 | NUE_OEX_1 | YLR315W | S. cerevisiae | 10999 | Cytoplasmic | — |
| 1 | 122 | NUE_OEX_1 | YLR329W | S. cerevisiae | 11005 | Cytoplasmic | — |
| 1 | 123 | NUE_OEX_1 | YLR362W | S. cerevisiae | 11013 | Cytoplasmic | — |
| 1 | 124 | NUE_OEX_1 | YLR395C | S. cerevisiae | 11055 | Cytoplasmic | — |
| 1 | 125 | NUE_OEX_1 | YLR404W | S. cerevisiae | 11067 | Cytoplasmic | — |
| 1 | 126 | NUE_OEX_1 | YLR463C | S. cerevisiae | 11075 | Cytoplasmic | — |
| 1 | 127 | NUE_OEX_1 | YML022W | S. cerevisiae | 11081 | Cytoplasmic | 11527, 11529, 11531, 11533, 11535, 11537, 11539, 11541, 11543, 11545, 11547 |
| 1 | 128 | NUE_OEX_1 | YML027W | S. cerevisiae | 11553 | Cytoplasmic | — |
| 1 | 129 | NUE_OEX_1 | YML065W | S. cerevisiae | 11570 | Cytoplasmic | — |
| 1 | 130 | NUE_OEX_1 | YML089C | S. cerevisiae | 11597 | Cytoplasmic | — |
| 1 | 131 | NUE_OEX_1 | YML128C | S. cerevisiae | 11601 | Cytoplasmic | — |
| 1 | 132 | NUE_OEX_1 | YMR011W | S. cerevisiae | 11613 | Cytoplasmic | 12125, 12127, 12129, 12131, 12133, 12135, 12137, 12139, 12141, 12143, 12145, 12147, 12149, 12151, 12153, 12155, 12157, 12159, 12161, 12163, 12165, 12167, 12169, 12171, 12173, 12175, 12177, 12179, 12181, 12183, 12185, 12187, 12189, 12191, 12193, 12195, 12197, 12199, 12201, 12203, 12205, 12207, 12209, 12211, 12213, 12215, 12217, 12219, 12221, 12223, 12225, 12227, 12229, 12231, 12233, 12235, 12237, 12239, 12241 |
| 1 | 133 | NUE_OEX_1 | YMR037C | S. cerevisiae | 12247 | Cytoplasmic | — |
| 1 | 134 | NUE_OEX_1 | YMR049C | S. cerevisiae | 12264 | Cytoplasmic | — |
| 1 | 135 | NUE_OEX_1 | YMR052W | S. cerevisiae | 12317 | Cytoplasmic | — |
| 1 | 136 | NUE_OEX_1 | YMR082C | S. cerevisiae | 12328 | Cytoplasmic | — |
| 1 | 137 | NUE_OEX_1 | YMR125W | S. cerevisiae | 12332 | Cytoplasmic | — |
| 1 | 138 | NUE_OEX_1 | YMR126C | S. cerevisiae | 12379 | Cytoplasmic | — |
| 1 | 139 | NUE_OEX_1 | YMR144W | S. cerevisiae | 12395 | Cytoplasmic | — |
| 1 | 140 | NUE_OEX_1 | YMR160W | S. cerevisiae | 12407 | Cytoplasmic | — |
| 1 | 141 | NUE_OEX_1 | YMR191W | S. cerevisiae | 12415 | Cytoplasmic | — |
| 1 | 142 | NUE_OEX_1 | YMR209C | S. cerevisiae | 12421 | Cytoplasmic | — |
| 1 | 143 | NUE_OEX_1 | YMR233W | S. cerevisiae | 12441 | Cytoplasmic | — |
| 1 | 144 | NUE_OEX_1 | YMR278W | S. cerevisiae | 12471 | Cytoplasmic | — |
| 1 | 145 | NUE_OEX_1 | YMR280C | S. cerevisiae | 12750 | Cytoplasmic | — |
| 1 | 146 | NUE_OEX_1 | YNL014W | S. cerevisiae | 12774 | Cytoplasmic | — |
| 1 | 147 | NUE_OEX_1 | YNL320W | S. cerevisiae | 12830 | Cytoplasmic | 12868, 12870, 12872, 12874 |
| 1 | 148 | NUE_OEX_1 | YOL007C | S. cerevisiae | 12884 | Cytoplasmic | — |
| 1 | 149 | NUE_OEX_1 | YOL164W | S. cerevisiae | 12890 | Cytoplasmic | — |
| 1 | 150 | NUE_OEX_1 | YOR076C | S. cerevisiae | 13015 | Cytoplasmic | — |
| 1 | 151 | NUE_OEX_1 | YOR083W | S. cerevisiae | 13019 | Cytoplasmic | — |
| 1 | 152 | NUE_OEX_1 | YOR097C | S. cerevisiae | 13025 | Cytoplasmic | — |
| 1 | 153 | NUE_OEX_1 | YOR128C | S. cerevisiae | 13031 | Cytoplasmic | 13099 |
| 1 | 154 | NUE_OEX_1 | YOR353C | S. cerevisiae | 14086 | Cytoplasmic | — |
| 1 | 155 | NUE_OEX_1 | YPL141C | S. cerevisiae | 14094 | Cytoplasmic | — |
| 1 | 156 | NUE_OEX_1 | YPR088C | S. cerevisiae | 14114 | Cytoplasmic | 14216, 14218, 14220, 14222, 14224, 14226, 14228, 14230, 14232, 14234 |
| 1 | 157 | NUE_OEX_1 | YPR108W | S. cerevisiae | 14247 | Cytoplasmic | 14291, 14293, 14295, 14297, 14299 |
| 1 | 158 | NUE_OEX_1 | YPR110C | S. cerevisiae | 14312 | Cytoplasmic | 14374, 14376, 14378, 14380, 14382 |
| 1 | 159 | NUE_OEX_1 | B3825_2 | E. coli | 14915 | Plastidic | — |
| 1 | 160 | NUE_OEX_1 | YIR034C_2 | S. cerevisiae | 15383 | Cytoplasmic | — |
| 1 | 161 | NUE_OEX_1 | YJR131W_2 | S. cerevisiae | 15461 | Cytoplasmic | 15557, 15559, 15561, 15563 |
| 1 | 162 | NUE_OEX_1 | YKL100C_2 | S. cerevisiae | 15572 | Cytoplasmic | — |
| 1 | 163 | NUE_OEX_1 | YKL193C_2 | S. cerevisiae | 15594 | Cytoplasmic | 15632, 15634, 15636, 15638 |
| 1 | 164 | NUE_OEX_1 | YLL016W_2 | S. cerevisiae | 15647 | Cytoplasmic | — |
| 1 | 165 | NUE_OEX_1 | YLR034C_2 | S. cerevisiae | 15674 | Cytoplasmic | 15978, 15980, 15982, 15984, 15986, 15988, 15990, 15992, 15994, 15996 |
| 1 | 166 | NUE_OEX_1 | YLR060W_2 | S. cerevisiae | 16006 | Cytoplasmic | — |
| 1 | 167 | NUE_OEX_1 | YMR082C_2 | S. cerevisiae | 16115 | Cytoplasmic | — |
| 1 | 168 | NUE_OEX_1 | B1258 | E. coli | 14403 | Cytoplasmic | — |
| 1 | 169 | NUE_OEX_1 | YML101C | S. cerevisiae | 16094 | Cytoplasmic | — |
| 1 | 170 | NUE_OEX_1 | YMR065W | S. cerevisiae | 16107 | Cytoplasmic | — |
| 1 | 171 | NUE_OEX_1 | YMR163C | S. cerevisiae | 16121 | Cytoplasmic | — |
| 1 | 172 | NUE_OEX_1 | YOL042W | S. cerevisiae | 16276 | Cytoplasmic | — |

TABLE IIB-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 173 | NUE_OEX_1 | YOR226C | S. cerevisiae | 16306 | Cytoplasmic | 16538, 16540, 16542, 16544, 16546, 16548, 16550, 16552, 16554, 16556, 16558, 16560, 16562, 16564, 16566 |
| 1 | 174 | NUE_OEX_1 | YPL068C | S. cerevisiae | 16574 | Cytoplasmic | — |
| 1 | 175 | NUE_OEX_1 | B0165 | E. coli | 14397 | Plastidic | — |
| 1 | 176 | NUE_OEX_1 | YOR203W | S. cerevisiae | 16300 | Cytoplasmic | — |
| 1 | 177 | NUE_OEX_1 | YNL147W | S. cerevisiae | 16134 | Cytoplasmic | 16258, 16260, 16262, 16264, 16266, 16268, 16270 |
| 1 | 178 | NUE_OEX_1 | YBR083W | S. cerevisiae | 15057 | Cytoplasmic | — |
| 1 | 179 | NUE_OEX_1 | YKL111C | S. cerevisiae | 15588 | Cytoplasmic | — |
| 1 | 180 | NUE_OEX_1 | YPR067W | S. cerevisiae | 16583 | Cytoplasmic | — |
| 1 | 181 | NUE_OEX_1 | B1985 | E. coli | 14840 | Cytoplasmic | — |
| 1 | 182 | NUE_OEX_1 | B3838 | E. coli | 15015 | Cytoplasmic | — |
| 1 | 183 | NUE_OEX_1 | YJL010C | S. cerevisiae | 15433 | Cytoplasmic | — |
| 1 | 184 | NUE_OEX_1 | B1267 | E. coli | 14498 | Cytoplasmic | 14710, 14712 |
| 1 | 185 | NUE_OEX_1 | B1322 | E. coli | 14719 | Cytoplasmic | — |
| 1 | 186 | NUE_OEX_1 | B1381 | E. coli | 14792 | Cytoplasmic | — |
| 1 | 187 | NUE_OEX_1 | B2646 | E. coli | 14880 | Cytoplasmic | — |
| 1 | 188 | NUE_OEX_1 | YBR191W | S. cerevisiae | 15065 | Cytoplasmic | 15219, 15221, 15223, 15225, 15227, 15229, 15231, 15233, 15235, 15237, 15239, 15241, 15243, 15245, 15247, 15249 |
| 1 | 189 | NUE_OEX_1 | YDL135C | S. cerevisiae | 15258 | Cytoplasmic | 15358, 15360, 15362, 15364, 15366, 15368, 15370, 15372 |
| 1 | 190 | NUE_OEX_1 | YHL005C | S. cerevisiae | 15379 | Cytoplasmic | — |
| 1 | 191 | NUE_OEX_1 | YKR100C_2 | S. cerevisiae | 16630 | Cytoplasmic | — |
| 1 | 192 | NUE_OEX_1 | YMR191W_2 | S. cerevisiae | 16648 | Cytoplasmic | — |

TABLE III

Primer nucleic acid sequence ID numbers

| Application | 1. Hit | 2. Project | 3. Locus | 4. Organism | 5. Lead SEQ ID | 6. Target | 7. SEQ IDs of Primers |
|---|---|---|---|---|---|---|---|
| 1 | 1 | NUE_OEX_1 | B0017 | E. coli | 38 | Cytoplasmic | 40, 41 |
| 1 | 2 | NUE_OEX_1 | B0045 | E. coli | 42 | Cytoplasmic | 118, 119 |
| 1 | 3 | NUE_OEX_1 | B0180 | E. coli | 123 | Plastidic | 375, 376 |
| 1 | 4 | NUE_OEX_1 | B0242 | E. coli | 380 | Plastidic | 670, 671 |
| 1 | 5 | NUE_OEX_1 | B0403 | E. coli | 679 | Plastidic | 801, 802 |
| 1 | 6 | NUE_OEX_1 | B0474 | E. coli | 812 | Cytoplasmic | 1050, 1051 |
| 1 | 7 | NUE_OEX_1 | B0754 | E. coli | 1055 | Plastidic | 1551, 1552 |
| 1 | 8 | NUE_OEX_1 | B0784 | E. coli | 1563 | Cytoplasmic | 1701, 1702 |
| 1 | 9 | NUE_OEX_1 | B0873 | E. coli | 1705 | Plastidic | 1831, 1832 |
| 1 | 10 | NUE_OEX_1 | B1014 | E. coli | 1844 | Cytoplasmic | 1932, 1933 |
| 1 | 11 | NUE_OEX_1 | B1020 | E. coli | 1950 | Plastidic | 1966, 1967 |
| 1 | 12 | NUE_OEX_1 | B1180 | E. coli | 1975 | Cytoplasmic | 2121, 2122 |
| 1 | 13 | NUE_OEX_1 | B1933 | E. coli | 2127 | Plastidic | 2133, 2134 |
| 1 | 14 | NUE_OEX_1 | B2032 | E. coli | 2135 | Plastidic | 2167, 2168 |
| 1 | 15 | NUE_OEX_1 | B2165 | E. coli | 2171 | Plastidic | 2289, 2290 |
| 1 | 16 | NUE_OEX_1 | B2223 | E. coli | 2297 | Plastidic | 2419, 2420 |
| 1 | 17 | NUE_OEX_1 | B2238 | E. coli | 2426 | Plastidic | 2444, 2445 |
| 1 | 17 | NUE_OEX_1 | B2238 | E. coli | 2426 | Cytoplasmic | 2444, 2445 |
| 1 | 18 | NUE_OEX_1 | B2310 | E. coli | 2452 | Plastidic | 2544, 2545 |
| 1 | 19 | NUE_OEX_1 | B2431 | E. coli | 2551 | Plastidic | 2591, 2592 |
| 1 | 20 | NUE_OEX_1 | B2600 | E. coli | 2600 | Plastidic | 2658, 2659 |
| 1 | 21 | NUE_OEX_1 | B2766 | E. coli | 2668 | Plastidic | 2766, 2767 |
| 1 | 22 | NUE_OEX_1 | B2903 | E. coli | 2772 | Cytoplasmic | 3100, 3101 |
| 1 | 23 | NUE_OEX_1 | B3117 | E. coli | 3117 | Plastidic | 3383, 3384 |
| 1 | 24 | NUE_OEX_1 | B3120 | E. coli | 3390 | Plastidic | 3394, 3395 |
| 1 | 25 | NUE_OEX_1 | B3216 | E. coli | 3396 | Plastidic | 3466, 3467 |
| 1 | 26 | NUE_OEX_1 | B3451 | E. coli | 3470 | Plastidic | 3556, 3557 |
| 1 | 27 | NUE_OEX_1 | B3791 | E. coli | 3563 | Cytoplasmic | 3765, 3766 |
| 1 | 28 | NUE_OEX_1 | B3825 | E. coli | 3770 | Plastidic | 3864, 3865 |
| 1 | 29 | NUE_OEX_1 | YAL019W | S. cerevisiae | 3868 | Cytoplasmic | 3878, 3879 |
| 1 | 30 | NUE_OEX_1 | YAR035W | S. cerevisiae | 3895 | Cytoplasmic | 3941, 3942 |
| 1 | 31 | NUE_OEX_1 | YBL021C | S. cerevisiae | 3953 | Cytoplasmic | 4107, 4108 |
| 1 | 32 | NUE_OEX_1 | YBR055C | S. cerevisiae | 4111 | Cytoplasmic | 4141, 4142 |
| 1 | 33 | NUE_OEX_1 | YBR128C | S. cerevisiae | 4149 | Cytoplasmic | 4157, 4158 |
| 1 | 34 | NUE_OEX_1 | YBR159W | S. cerevisiae | 4162 | Cytoplasmic | 4228, 4229 |
| 1 | 35 | NUE_OEX_1 | YBR243C | S. cerevisiae | 4235 | Cytoplasmic | 4271, 4272 |
| 1 | 35 | NUE_OEX_1 | YBR243C | S. cerevisiae | 4235 | Plastidic | 4271, 4272 |
| 1 | 36 | NUE_OEX_1 | YBR262C | S. cerevisiae | 4280 | Cytoplasmic | 4286, 4287 |
| 1 | 37 | NUE_OEX_1 | YCR019W | S. cerevisiae | 4288 | Cytoplasmic | 4306, 4307 |
| 1 | 38 | NUE_OEX_1 | YDR070C | S. cerevisiae | 4315 | Cytoplasmic | 4321, 4322 |

TABLE III-continued

Primer nucleic acid sequence ID numbers

| Application | 1. Hit | 2. Project | 3. Locus | 4. Organism | 5. Lead SEQ ID | 6. Target | 7. SEQ IDs of Primers |
|---|---|---|---|---|---|---|---|
| 1 | 39 | NUE_OEX_1 | YDR079W | S. cerevisiae | 4325 | Cytoplasmic | 4331, 4332 |
| 1 | 40 | NUE_OEX_1 | YDR123C | S. cerevisiae | 4335 | Cytoplasmic | 4341, 4342 |
| 1 | 41 | NUE_OEX_1 | YDR137W | S. cerevisiae | 4346 | Cytoplasmic | 4352, 4353 |
| 1 | 42 | NUE_OEX_1 | YDR294C | S. cerevisiae | 4361 | Cytoplasmic | 4391, 4392 |
| 1 | 42 | NUE_OEX_1 | YDR294C | S. cerevisiae | 4361 | Plastidic | 4391, 4392 |
| 1 | 43 | NUE_OEX_1 | YDR330W | S. cerevisiae | 4402 | Cytoplasmic | 4424, 4425 |
| 1 | 44 | NUE_OEX_1 | YDR355C | S. cerevisiae | 4431 | Cytoplasmic | 4433, 4434 |
| 1 | 45 | NUE_OEX_1 | YDR430C | S. cerevisiae | 4435 | Plastidic | 4469, 4470 |
| 1 | 46 | NUE_OEX_1 | YDR472W | S. cerevisiae | 4485 | Cytoplasmic | 4497, 4498 |
| 1 | 47 | NUE_OEX_1 | YDR497C | S. cerevisiae | 4506 | Plastidic | 4786, 4787 |
| 1 | 48 | NUE_OEX_1 | YER029C | S. cerevisiae | 4790 | Cytoplasmic | 4800, 4801 |
| 1 | 49 | NUE_OEX_1 | YFR007W | S. cerevisiae | 4806 | Cytoplasmic | 4830, 4831 |
| 1 | 50 | NUE_OEX_1 | YGL039W | S. cerevisiae | 4836 | Cytoplasmic | 5306, 5307 |
| 1 | 51 | NUE_OEX_1 | YGL043W | S. cerevisiae | 5311 | Cytoplasmic | 5341, 5342 |
| 1 | 52 | NUE_OEX_1 | YGR088W | S. cerevisiae | 5346 | Cytoplasmic | 5526, 5527 |
| 1 | 53 | NUE_OEX_1 | YGR122C-A | S. cerevisiae | 5533 | Cytoplasmic | 5547, 5548 |
| 1 | 54 | NUE_OEX_1 | YGR142W | S. cerevisiae | 5551 | Cytoplasmic | 5557, 5558 |
| 1 | 55 | NUE_OEX_1 | YGR143W | S. cerevisiae | 5559 | Cytoplasmic | 5587, 5588 |
| 1 | 56 | NUE_OEX_1 | YGR165W | S. cerevisiae | 5602 | Cytoplasmic | 5606, 5607 |
| 1 | 57 | NUE_OEX_1 | YGR170W | S. cerevisiae | 5608 | Cytoplasmic | 5612, 5613 |
| 1 | 58 | NUE_OEX_1 | YGR202C | S. cerevisiae | 5614 | Cytoplasmic | 5660, 5661 |
| 1 | 59 | NUE_OEX_1 | YGR266W | S. cerevisiae | 5666 | Cytoplasmic | 5688, 5689 |
| 1 | 60 | NUE_OEX_1 | YGR282C | S. cerevisiae | 5701 | Cytoplasmic | 5741, 5742 |
| 1 | 61 | NUE_OEX_1 | YGR290W | S. cerevisiae | 5750 | Cytoplasmic | 5752, 5753 |
| 1 | 62 | NUE_OEX_1 | YHL021C | S. cerevisiae | 5754 | Cytoplasmic | 5770, 5771 |
| 1 | 63 | NUE_OEX_1 | YHL031C | S. cerevisiae | 5778 | Cytoplasmic | 5808, 5809 |
| 1 | 64 | NUE_OEX_1 | YHR011W | S. cerevisiae | 5812 | Cytoplasmic | 5960, 5961 |
| 1 | 65 | NUE_OEX_1 | YHR127W | S. cerevisiae | 5967 | Cytoplasmic | 5971, 5972 |
| 1 | 66 | NUE_OEX_1 | YHR137W | S. cerevisiae | 5973 | Cytoplasmic | 6021, 6022 |
| 1 | 66 | NUE_OEX_1 | YHR137W | S. cerevisiae | 5973 | Plastidic | 6021, 6022 |
| 1 | 67 | NUE_OEX_1 | YIL099W | S. cerevisiae | 6027 | Cytoplasmic | 6099, 6100 |
| 1 | 67 | NUE_OEX_1 | YIL099W | S. cerevisiae | 6027 | Plastidic | 6099, 6100 |
| 1 | 68 | NUE_OEX_1 | YIL147C | S. cerevisiae | 6107 | Cytoplasmic | 6133, 6134 |
| 1 | 69 | NUE_OEX_1 | YIR034C | S. cerevisiae | 6150 | Cytoplasmic | 6186, 6187 |
| 1 | 70 | NUE_OEX_1 | YJL013C | S. cerevisiae | 6198 | Cytoplasmic | 6206, 6207 |
| 1 | 71 | NUE_OEX_1 | YJL041W | S. cerevisiae | 6208 | Cytoplasmic | 6236, 6237 |
| 1 | 72 | NUE_OEX_1 | YJL064W | S. cerevisiae | 6242 | Cytoplasmic | 6244, 6245 |
| 1 | 73 | NUE_OEX_1 | YJL067W | S. cerevisiae | 6246 | Cytoplasmic | 6248, 6249 |
| 1 | 74 | NUE_OEX_1 | YJL094C | S. cerevisiae | 6250 | Cytoplasmic | 6286, 6287 |
| 1 | 75 | NUE_OEX_1 | YJL171C | S. cerevisiae | 6297 | Cytoplasmic | 6317, 6318 |
| 1 | 76 | NUE_OEX_1 | YJL213W | S. cerevisiae | 6326 | Cytoplasmic | 6482, 6483 |
| 1 | 77 | NUE_OEX_1 | YJR017C | S. cerevisiae | 6488 | Cytoplasmic | 6544, 6545 |
| 1 | 78 | NUE_OEX_1 | YJR058C | S. cerevisiae | 6550 | Cytoplasmic | 6696, 6697 |
| 1 | 79 | NUE_OEX_1 | YJR117W | S. cerevisiae | 6700 | Cytoplasmic | 6808, 6809 |
| 1 | 80 | NUE_OEX_1 | YJR121W | S. cerevisiae | 6816 | Cytoplasmic | 7350, 7351 |
| 1 | 81 | NUE_OEX_1 | YJR131W | S. cerevisiae | 7366 | Cytoplasmic | 7468, 7469 |
| 1 | 82 | NUE_OEX_1 | YJR145C | S. cerevisiae | 7475 | Cytoplasmic | 7597, 7598 |
| 1 | 83 | NUE_OEX_1 | YKL084W | S. cerevisiae | 7602 | Cytoplasmic | 7646, 7647 |
| 1 | 84 | NUE_OEX_1 | YKL088W | S. cerevisiae | 7651 | Cytoplasmic | 7655, 7656 |
| 1 | 85 | NUE_OEX_1 | YKL100C | S. cerevisiae | 7661 | Cytoplasmic | 7669, 7670 |
| 1 | 86 | NUE_OEX_1 | YKL131W | S. cerevisiae | 7675 | Cytoplasmic | 7677, 7678 |
| 1 | 87 | NUE_OEX_1 | YKL138C | S. cerevisiae | 7679 | Cytoplasmic | 7705, 7706 |
| 1 | 88 | NUE_OEX_1 | YKL178C | S. cerevisiae | 7710 | Cytoplasmic | 7720, 7721 |
| 1 | 89 | NUE_OEX_1 | YKL179C | S. cerevisiae | 7735 | Cytoplasmic | 7769, 7770 |
| 1 | 90 | NUE_OEX_1 | YKL193C | S. cerevisiae | 7778 | Cytoplasmic | 7822, 7823 |
| 1 | 91 | NUE_OEX_1 | YKL216W | S. cerevisiae | 7829 | Cytoplasmic | 8013, 8014 |
| 1 | 92 | NUE_OEX_1 | YKR016W | S. cerevisiae | 8017 | Cytoplasmic | 8039, 8040 |
| 1 | 93 | NUE_OEX_1 | YKR021W | S. cerevisiae | 8045 | Cytoplasmic | 8061, 8062 |
| 1 | 94 | NUE_OEX_1 | YKR055W | S. cerevisiae | 8073 | Cytoplasmic | 8259, 8260 |
| 1 | 95 | NUE_OEX_1 | YKR088C | S. cerevisiae | 8263 | Plastidic | 8281, 8282 |
| 1 | 96 | NUE_OEX_1 | YKR093W | S. cerevisiae | 8287 | Cytoplasmic | 8463, 8464 |
| 1 | 97 | NUE_OEX_1 | YKR099W | S. cerevisiae | 8468 | Cytoplasmic | 8474, 8475 |
| 1 | 98 | NUE_OEX_1 | YKR100C | S. cerevisiae | 8484 | Cytoplasmic | 8490, 8491 |
| 1 | 99 | NUE_OEX_1 | YLL014W | S. cerevisiae | 8492 | Cytoplasmic | 8510, 8511 |
| 1 | 100 | NUE_OEX_1 | YLL016W | S. cerevisiae | 8514 | Cytoplasmic | 8528, 8529 |
| 1 | 101 | NUE_OEX_1 | YLL023C | S. cerevisiae | 8539 | Cytoplasmic | 8567, 8568 |
| 1 | 102 | NUE_OEX_1 | YLL037W | S. cerevisiae | 8571 | Cytoplasmic | 8573, 8574 |
| 1 | 103 | NUE_OEX_1 | YLL049W | S. cerevisiae | 8575 | Cytoplasmic | 8577, 8578 |
| 1 | 104 | NUE_OEX_1 | YLL055W | S. cerevisiae | 8579 | Cytoplasmic | 8657, 8658 |
| 1 | 105 | NUE_OEX_1 | YLR034C | S. cerevisiae | 8661 | Cytoplasmic | 8983, 8984 |
| 1 | 106 | NUE_OEX_1 | YLR042C | S. cerevisiae | 8991 | Cytoplasmic | 8993, 8994 |
| 1 | 107 | NUE_OEX_1 | YLR053C | S. cerevisiae | 8995 | Cytoplasmic | 8997, 8998 |
| 1 | 108 | NUE_OEX_1 | YLR058C | S. cerevisiae | 8999 | Cytoplasmic | 9541, 9542 |
| 1 | 109 | NUE_OEX_1 | YLR060W | S. cerevisiae | 9551 | Cytoplasmic | 9629, 9630 |

TABLE III-continued

Primer nucleic acid sequence ID numbers

| Application | 1. Hit | 2. Project | 3. Locus | 4. Organism | 5. Lead SEQ ID | 6. Target | 7. SEQ IDs of Primers |
|---|---|---|---|---|---|---|---|
| 1 | 110 | NUE_OEX_1 | YLR065C | S. cerevisiae | 9637 | Cytoplasmic | 9669, 9670 |
| 1 | 111 | NUE_OEX_1 | YLR070C | S. cerevisiae | 9672 | Cytoplasmic | 10178, 10179 |
| 1 | 112 | NUE_OEX_1 | YLR100W | S. cerevisiae | 10182 | Cytoplasmic | 10204, 10205 |
| 1 | 113 | NUE_OEX_1 | YLR109W | S. cerevisiae | 10214 | Cytoplasmic | 10444, 10445 |
| 1 | 114 | NUE_OEX_1 | YLR125W | S. cerevisiae | 10447 | Cytoplasmic | 10449, 10450 |
| 1 | 115 | NUE_OEX_1 | YLR127C | S. cerevisiae | 10451 | Cytoplasmic | 10461, 10462 |
| 1 | 116 | NUE_OEX_1 | YLR185W | S. cerevisiae | 10463 | Cytoplasmic | 10527, 10528 |
| 1 | 117 | NUE_OEX_1 | YLR204W | S. cerevisiae | 10533 | Cytoplasmic | 10539, 10540 |
| 1 | 117 | NUE_OEX_1 | YLR204W | S. cerevisiae | 10533 | Plastidic | 10539, 10540 |
| 1 | 118 | NUE_OEX_1 | YLR242C | S. cerevisiae | 10541 | Cytoplasmic | 10555, 10556 |
| 1 | 119 | NUE_OEX_1 | YLR293C | S. cerevisiae | 10562 | Cytoplasmic | 10984, 10985 |
| 1 | 120 | NUE_OEX_1 | YLR313C | S. cerevisiae | 10990 | Cytoplasmic | 10996, 10997 |
| 1 | 121 | NUE_OEX_1 | YLR315W | S. cerevisiae | 10998 | Cytoplasmic | 11002, 11003 |
| 1 | 122 | NUE_OEX_1 | YLR329W | S. cerevisiae | 11004 | Cytoplasmic | 11010, 11011 |
| 1 | 123 | NUE_OEX_1 | YLR362W | S. cerevisiae | 11012 | Cytoplasmic | 11044, 11045 |
| 1 | 124 | NUE_OEX_1 | YLR395C | S. cerevisiae | 11054 | Cytoplasmic | 11062, 11063 |
| 1 | 125 | NUE_OEX_1 | YLR404W | S. cerevisiae | 11066 | Cytoplasmic | 11072, 11073 |
| 1 | 126 | NUE_OEX_1 | YLR463C | S. cerevisiae | 11074 | Cytoplasmic | 11078, 11079 |
| 1 | 127 | NUE_OEX_1 | YML022W | S. cerevisiae | 11080 | Cytoplasmic | 11548, 11549 |
| 1 | 128 | NUE_OEX_1 | YML027W | S. cerevisiae | 11552 | Cytoplasmic | 11564, 11565 |
| 1 | 129 | NUE_OEX_1 | YML065W | S. cerevisiae | 11569 | Cytoplasmic | 11587, 11588 |
| 1 | 130 | NUE_OEX_1 | YML089C | S. cerevisiae | 11596 | Cytoplasmic | 11598, 11599 |
| 1 | 131 | NUE_OEX_1 | YML128C | S. cerevisiae | 11600 | Cytoplasmic | 11610, 11611 |
| 1 | 132 | NUE_OEX_1 | YMR011W | S. cerevisiae | 11612 | Cytoplasmic | 12242, 12243 |
| 1 | 133 | NUE_OEX_1 | YMR037C | S. cerevisiae | 12246 | Cytoplasmic | 12256, 12257 |
| 1 | 134 | NUE_OEX_1 | YMR049C | S. cerevisiae | 12263 | Cytoplasmic | 12299, 12300 |
| 1 | 135 | NUE_OEX_1 | YMR052W | S. cerevisiae | 12316 | Cytoplasmic | 12322, 12323 |
| 1 | 136 | NUE_OEX_1 | YMR082C | S. cerevisiae | 12327 | Cytoplasmic | 12329, 12330 |
| 1 | 137 | NUE_OEX_1 | YMR125W | S. cerevisiae | 12331 | Cytoplasmic | 12367, 12368 |
| 1 | 138 | NUE_OEX_1 | YMR126C | S. cerevisiae | 12378 | Cytoplasmic | 12386, 12387 |
| 1 | 139 | NUE_OEX_1 | YMR144W | S. cerevisiae | 12394 | Cytoplasmic | 12400, 12401 |
| 1 | 140 | NUE_OEX_1 | YMR160W | S. cerevisiae | 12406 | Cytoplasmic | 12412, 12413 |
| 1 | 141 | NUE_OEX_1 | YMR191W | S. cerevisiae | 12414 | Cytoplasmic | 12418, 12419 |
| 1 | 142 | NUE_OEX_1 | YMR209C | S. cerevisiae | 12420 | Cytoplasmic | 12430, 12431 |
| 1 | 143 | NUE_OEX_1 | YMR233W | S. cerevisiae | 12440 | Cytoplasmic | 12466, 12467 |
| 1 | 144 | NUE_OEX_1 | YMR278W | S. cerevisiae | 12470 | Cytoplasmic | 12740, 12741 |
| 1 | 145 | NUE_OEX_1 | YMR280C | S. cerevisiae | 12749 | Cytoplasmic | 12757, 12758 |
| 1 | 146 | NUE_OEX_1 | YNL014W | S. cerevisiae | 12773 | Cytoplasmic | 12811, 12812 |
| 1 | 147 | NUE_OEX_1 | YNL320W | S. cerevisiae | 12829 | Cytoplasmic | 12875, 12876 |
| 1 | 148 | NUE_OEX_1 | YOL007C | S. cerevisiae | 12883 | Cytoplasmic | 12887, 12888 |
| 1 | 149 | NUE_OEX_1 | YOL164W | S. cerevisiae | 12889 | Cytoplasmic | 13001, 13002 |
| 1 | 150 | NUE_OEX_1 | YOR076C | S. cerevisiae | 13014 | Cytoplasmic | 13016, 13017 |
| 1 | 151 | NUE_OEX_1 | YOR083W | S. cerevisiae | 13018 | Cytoplasmic | 13022, 13023 |
| 1 | 152 | NUE_OEX_1 | YOR097C | S. cerevisiae | 13024 | Cytoplasmic | 13028, 13029 |
| 1 | 153 | NUE_OEX_1 | YOR128C | S. cerevisiae | 13030 | Cytoplasmic | 13100, 13101 |
| 1 | 154 | NUE_OEX_1 | YOR353C | S. cerevisiae | 14085 | Cytoplasmic | 14091, 14092 |
| 1 | 155 | NUE_OEX_1 | YPL141C | S. cerevisiae | 14093 | Cytoplasmic | 14101, 14102 |
| 1 | 156 | NUE_OEX_1 | YPR088C | S. cerevisiae | 14113 | Cytoplasmic | 14235, 14236 |
| 1 | 157 | NUE_OEX_1 | YPR108W | S. cerevisiae | 14246 | Cytoplasmic | 14300, 14301 |
| 1 | 158 | NUE_OEX_1 | YPR110C | S. cerevisiae | 14311 | Cytoplasmic | 14383, 14384 |
| 1 | 159 | NUE_OEX_1 | B3825_2 | E. coli | 14914 | Plastidic | 15010, 15011 |
| 1 | 160 | NUE_OEX_1 | YIR034C_2 | S. cerevisiae | 15382 | Cytoplasmic | 15420, 15421 |
| 1 | 161 | NUE_OEX_1 | YJR131W_2 | S. cerevisiae | 15460 | Cytoplasmic | 15564, 15565 |
| 1 | 162 | NUE_OEX_1 | YKL100C_2 | S. cerevisiae | 15571 | Cytoplasmic | 15581, 15582 |
| 1 | 163 | NUE_OEX_1 | YKL193C_2 | S. cerevisiae | 15593 | Cytoplasmic | 15639, 15640 |
| 1 | 164 | NUE_OEX_1 | YLL016W_2 | S. cerevisiae | 15646 | Cytoplasmic | 15662, 15663 |
| 1 | 165 | NUE_OEX_1 | YLR034C_2 | S. cerevisiae | 15673 | Cytoplasmic | 15997, 15998 |
| 1 | 166 | NUE_OEX_1 | YLR060W_2 | S. cerevisiae | 16005 | Cytoplasmic | 16085, 16086 |
| 1 | 167 | NUE_OEX_1 | YMR082C_2 | S. cerevisiae | 16114 | Cytoplasmic | 16118, 16119 |
| 1 | 168 | NUE_OEX_1 | B1258 | E. coli | 14402 | Cytoplasmic | 14492, 14493 |
| 1 | 169 | NUE_OEX_1 | YML101C | S. cerevisiae | 16093 | Cytoplasmic | 16101, 16102 |
| 1 | 170 | NUE_OEX_1 | YMR065W | S. cerevisiae | 16106 | Cytoplasmic | 16112, 16113 |
| 1 | 171 | NUE_OEX_1 | YMR163C | S. cerevisiae | 16120 | Cytoplasmic | 16128, 16129 |
| 1 | 172 | NUE_OEX_1 | YOL042W | S. cerevisiae | 16275 | Cytoplasmic | 16289, 16290 |
| 1 | 173 | NUE_OEX_1 | YOR226C | S. cerevisiae | 16305 | Cytoplasmic | 16567, 16568 |
| 1 | 174 | NUE_OEX_1 | YPL068C | S. cerevisiae | 16573 | Cytoplasmic | 16579, 16580 |
| 1 | 175 | NUE_OEX_1 | B0165 | E. coli | 14396 | Plastidic | 14400, 14401 |
| 1 | 176 | NUE_OEX_1 | YOR203W | S. cerevisiae | 16299 | Cytoplasmic | 16303, 16304 |
| 1 | 177 | NUE_OEX_1 | YNL147W | S. cerevisiae | 16133 | Cytoplasmic | 16271, 16272 |
| 1 | 178 | NUE_OEX_1 | YBR083W | S. cerevisiae | 15056 | Cytoplasmic | 15062, 15063 |
| 1 | 179 | NUE_OEX_1 | YKL111C | S. cerevisiae | 15587 | Cytoplasmic | 15591, 15592 |
| 1 | 180 | NUE_OEX_1 | YPR067W | S. cerevisiae | 16582 | Cytoplasmic | 16624, 16625 |
| 1 | 181 | NUE_OEX_1 | B1985 | E. coli | 14839 | Cytoplasmic | 14867, 14868 |
| 1 | 182 | NUE_OEX_1 | B3838 | E. coli | 15014 | Cytoplasmic | 15050, 15051 |

TABLE III-continued

Primer nucleic acid sequence ID numbers

| Application | 1. Hit | 2. Project | 3. Locus | 4. Organism | 5. Lead SEQ ID | 6. Target | 7. SEQ IDs of Primers |
|---|---|---|---|---|---|---|---|
| 1 | 183 | NUE_OEX_1 | YJL010C | S. cerevisiae | 15432 | Cytoplasmic | 15450, 15451 |
| 1 | 184 | NUE_OEX_1 | B1267 | E. coli | 14497 | Cytoplasmic | 14713, 14714 |
| 1 | 185 | NUE_OEX_1 | B1322 | E. coli | 14718 | Cytoplasmic | 14786, 14787 |
| 1 | 186 | NUE_OEX_1 | B1381 | E. coli | 14791 | Cytoplasmic | 14821, 14822 |
| 1 | 187 | NUE_OEX_1 | B2646 | E. coli | 14879 | Cytoplasmic | 14909, 14910 |
| 1 | 188 | NUE_OEX_1 | YBR191W | S. cerevisiae | 15064 | Cytoplasmic | 15250, 15251 |
| 1 | 189 | NUE_OEX_1 | YDL135C | S. cerevisiae | 15257 | Cytoplasmic | 15373, 15374 |
| 1 | 190 | NUE_OEX_1 | YHL005C | S. cerevisiae | 15378 | Cytoplasmic | 15380, 15381 |
| 1 | 191 | NUE_OEX_1 | YKR100C_2 | S. cerevisiae | 16629 | Cytoplasmic | 16639, 16640 |
| 1 | 192 | NUE_OEX_1 | YMR191W_2 | S. cerevisiae | 16647 | Cytoplasmic | 16653, 16654 |

TABLE IV

Consensus amino acid sequence ID numbers

| Application | 1. Hit | 2. Project | 3. Locus | 4. Organism | 5. Lead SEQ ID | 6. Target | 7. SEQ IDs of Consensus/Pattern Sequences |
|---|---|---|---|---|---|---|---|
| 1 | 1 | NUE_OEX_1 | B0017 | E. coli | 39 | Cytoplasmic | — |
| 1 | 2 | NUE_OEX_1 | B0045 | E. coli | 43 | Cytoplasmic | 120, 121, 122 |
| 1 | 3 | NUE_OEX_1 | B0180 | E. coli | 124 | Plastidic | 377, 378, 379 |
| 1 | 4 | NUE_OEX_1 | B0242 | E. coli | 381 | Plastidic | 672, 673, 674, 675, 676, 677, 678 |
| 1 | 5 | NUE_OEX_1 | B0403 | E. coli | 680 | Plastidic | 803, 804, 805, 806, 807, 808, 809, 810, 811 |
| 1 | 6 | NUE_OEX_1 | B0474 | E. coli | 813 | Cytoplasmic | 1052, 1053, 1054 |
| 1 | 7 | NUE_OEX_1 | B0754 | E. coli | 1056 | Plastidic | 1553, 1554, 1555, 1556, 1557, 1558, 1559, 1560, 1561, 1562 |
| 1 | 8 | NUE_OEX_1 | B0784 | E. coli | 1564 | Cytoplasmic | 1703, 1704 |
| 1 | 9 | NUE_OEX_1 | B0873 | E. coli | 1706 | Plastidic | 1833, 1834, 1835, 1836, 1837, 1838, 1839, 1840, 1841, 1842, 1843 |
| 1 | 10 | NUE_OEX_1 | B1014 | E. coli | 1845 | Cytoplasmic | 1934, 1935, 1936, 1937, 1938, 1939, 1940, 1941, 1942, 1943, 1944, 1945, 1946, 1947, 1948, 1949 |
| 1 | 11 | NUE_OEX_1 | B1020 | E. coli | 1951 | Plastidic | 1968, 1969, 1970, 1971, 1972, 1973, 1974 |
| 1 | 12 | NUE_OEX_1 | B1180 | E. coli | 1976 | Cytoplasmic | 2123, 2124, 2125, 2126 |
| 1 | 13 | NUE_OEX_1 | B1933 | E. coli | 2128 | Plastidic | — |
| 1 | 14 | NUE_OEX_1 | B2032 | E. coli | 2136 | Plastidic | 2169, 2170 |
| 1 | 15 | NUE_OEX_1 | B2165 | E. coli | 2172 | Plastidic | 2291, 2292, 2293, 2294, 2295, 2296 |
| 1 | 16 | NUE_OEX_1 | B2223 | E. coli | 2298 | Plastidic | 2421, 2422, 2423, 2424, 2425 |
| 1 | 17 | NUE_OEX_1 | B2238 | E. coli | 2427 | Plastidic | 2446, 2447, 2448, 2449, 2450, 2451 |
| 1 | 17 | NUE_OEX_1 | B2238 | E. coli | 2427 | Cytoplasmic | 2446, 2447, 2448, 2449, 2450, 2451 |
| 1 | 18 | NUE_OEX_1 | B2310 | E. coli | 2453 | Plastidic | 2546, 2547, 2548, 2549, 2550 |
| 1 | 19 | NUE_OEX_1 | B2431 | E. coli | 2552 | Plastidic | 2593, 2594, 2595, 2596, 2597, 2598, 2599 |
| 1 | 20 | NUE_OEX_1 | B2600 | E. coli | 2601 | Plastidic | 2660, 2661, 2662, 2663, 2664, 2665, 2666, 2667 |
| 1 | 21 | NUE_OEX_1 | B2766 | E. coli | 2669 | Plastidic | 2768, 2769, 2770, 2771 |
| 1 | 22 | NUE_OEX_1 | B2903 | E. coli | 2773 | Cytoplasmic | 3102, 3103, 3104, 3105, 3106, 3107, 3108, 3109, 3110, 3111, 3112, 3113, 3114, 3115, 3116 |
| 1 | 23 | NUE_OEX_1 | B3117 | E. coli | 3118 | Plastidic | 3385, 3386, 3387, 3388, 3389 |
| 1 | 24 | NUE_OEX_1 | B3120 | E. coli | 3391 | Plastidic | — |
| 1 | 25 | NUE_OEX_1 | B3216 | E. coli | 3397 | Plastidic | 3468, 3469 |
| 1 | 26 | NUE_OEX_1 | B3451 | E. coli | 3471 | Plastidic | 3558, 3559, 3560, 3561, 3562 |
| 1 | 27 | NUE_OEX_1 | B3791 | E. coli | 3564 | Cytoplasmic | 3767, 3768, 3769 |
| 1 | 28 | NUE_OEX_1 | B3825 | E. coli | 3771 | Plastidic | 3866, 3867 |
| 1 | 29 | NUE_OEX_1 | YAL019W | S. cerevisiae | 3869 | Cytoplasmic | 3880, 3881, 3882, 3883, 3884, 3885, 3886, 3887, 3888, 3889, 3890, 3891, 3892, 3893, 3894 |
| 1 | 30 | NUE_OEX_1 | YAR035W | S. cerevisiae | 3896 | Cytoplasmic | 3943, 3944, 3945, 3946, 3947, 3948, 3949, 3950, 3951, 3952 |
| 1 | 31 | NUE_OEX_1 | YBL021C | S. cerevisiae | 3954 | Cytoplasmic | 4109, 4110 |
| 1 | 32 | NUE_OEX_1 | YBR055C | S. cerevisiae | 4112 | Cytoplasmic | 4143, 4144, 4145, 4146, 4147, 4148 |
| 1 | 33 | NUE_OEX_1 | YBR128C | S. cerevisiae | 4150 | Cytoplasmic | 4159, 4160, 4161 |
| 1 | 34 | NUE_OEX_1 | YBR159W | S. cerevisiae | 4163 | Cytoplasmic | 4230, 4231, 4232, 4233, 4234 |
| 1 | 35 | NUE_OEX_1 | YBR243C | S. cerevisiae | 4236 | Cytoplasmic | 4273, 4274, 4275, 4276, 4277, 4278, 4279 |
| 1 | 35 | NUE_OEX_1 | YBR243C | S. cerevisiae | 4236 | Plastidic | 4273, 4274, 4275, 4276, 4277, 4278, 4279 |
| 1 | 36 | NUE_OEX_1 | YBR262C | S. cerevisiae | 4281 | Cytoplasmic | — |
| 1 | 37 | NUE_OEX_1 | YCR019W | S. cerevisiae | 4289 | Cytoplasmic | 4308, 4309, 4310, 4311, 4312, 4313, 4314 |
| 1 | 38 | NUE_OEX_1 | YDR070C | S. cerevisiae | 4316 | Cytoplasmic | 4323, 4324 |
| 1 | 39 | NUE_OEX_1 | YDR079W | S. cerevisiae | 4326 | Cytoplasmic | 4333, 4334 |
| 1 | 40 | NUE_OEX_1 | YDR123C | S. cerevisiae | 4336 | Cytoplasmic | 4343, 4344, 4345 |
| 1 | 41 | NUE_OEX_1 | YDR137W | S. cerevisiae | 4347 | Cytoplasmic | 4354, 4355, 4356, 4357, 4358, 4359, 4360 |
| 1 | 42 | NUE_OEX_1 | YDR294C | S. cerevisiae | 4362 | Cytoplasmic | 4393, 4394, 4395, 4396, 4397, 4398, 4399, 4400, 4401 |
| 1 | 42 | NUE_OEX_1 | YDR294C | S. cerevisiae | 4362 | Plastidic | 4393, 4394, 4395, 4396, 4397, 4398, 4399, 4400, 4401 |
| 1 | 43 | NUE_OEX_1 | YDR330W | S. cerevisiae | 4403 | Cytoplasmic | 4426, 4427, 4428, 4429, 4430 |
| 1 | 44 | NUE_OEX_1 | YDR355C | S. cerevisiae | 4432 | Cytoplasmic | — |

TABLE IV-continued

Consensus amino acid sequence ID numbers

| Appli-cation | 1. Hit | 2. Project | 3. Locus | 4. Organism | 5. Lead SEQ ID | 6. Target | 7. SEQ IDs of Consensus/Pattern Sequences |
|---|---|---|---|---|---|---|---|
| 1 | 45 | NUE_OEX_1 | YDR430C | S. cerevisiae | 4436 | Plastidic | 4471, 4472, 4473, 4474, 4475, 4476, 4477, 4478, 4479, 4480, 4481, 4482, 4483, 4484 |
| 1 | 46 | NUE_OEX_1 | YDR472W | S. cerevisiae | 4486 | Cytoplasmic | 4499, 4500, 4501, 4502, 4503, 4504, 4505 |
| 1 | 47 | NUE_OEX_1 | YDR497C | S. cerevisiae | 4507 | Plastidic | 4788, 4789 |
| 1 | 48 | NUE_OEX_1 | YER029C | S. cerevisiae | 4791 | Cytoplasmic | 4802, 4803, 4804, 4805 |
| 1 | 49 | NUE_OEX_1 | YFR007W | S. cerevisiae | 4807 | Cytoplasmic | 4832, 4833, 4834, 4835 |
| 1 | 50 | NUE_OEX_1 | YGL039W | S. cerevisiae | 4837 | Cytoplasmic | 5308, 5309, 5310 |
| 1 | 51 | NUE_OEX_1 | YGL043W | S. cerevisiae | 5312 | Cytoplasmic | 5343, 5344, 5345 |
| 1 | 52 | NUE_OEX_1 | YGR088W | S. cerevisiae | 5347 | Cytoplasmic | 5528, 5529, 5530, 5531, 5532 |
| 1 | 53 | NUE_OEX_1 | YGR122C-A | S. cerevisiae | 5534 | Cytoplasmic | 5549, 5550 |
| 1 | 54 | NUE_OEX_1 | YGR142W | S. cerevisiae | 5552 | Cytoplasmic | — |
| 1 | 55 | NUE_OEX_1 | YGR143W | S. cerevisiae | 5560 | Cytoplasmic | 5589, 5590, 5591, 5592, 5593, 5594, 5595, 5596, 5597, 5598, 5599, 5600, 5601 |
| 1 | 56 | NUE_OEX_1 | YGR165W | S. cerevisiae | 5603 | Cytoplasmic | — |
| 1 | 57 | NUE_OEX_1 | YGR170W | S. cerevisiae | 5609 | Cytoplasmic | — |
| 1 | 58 | NUE_OEX_1 | YGR202C | S. cerevisiae | 5615 | Cytoplasmic | 5662, 5663, 5664, 5665 |
| 1 | 59 | NUE_OEX_1 | YGR266W | S. cerevisiae | 5667 | Cytoplasmic | 5690, 5691, 5692, 5693, 5694, 5695, 5696, 5697, 5698, 5699, 5700 |
| 1 | 60 | NUE_OEX_1 | YGR282C | S. cerevisiae | 5702 | Cytoplasmic | 5743, 5744, 5745, 5746, 5747, 5748, 5749 |
| 1 | 61 | NUE_OEX_1 | YGR290W | S. cerevisiae | 5751 | Cytoplasmic | — |
| 1 | 62 | NUE_OEX_1 | YHL021C | S. cerevisiae | 5755 | Cytoplasmic | 5772, 5773, 5774, 5775, 5776, 5777 |
| 1 | 63 | NUE_OEX_1 | YHL031C | S. cerevisiae | 5779 | Cytoplasmic | 5810, 5811 |
| 1 | 64 | NUE_OEX_1 | YHR011W | S. cerevisiae | 5813 | Cytoplasmic | 5962, 5963, 5964, 5965, 5966 |
| 1 | 65 | NUE_OEX_1 | YHR127W | S. cerevisiae | 5968 | Cytoplasmic | — |
| 1 | 66 | NUE_OEX_1 | YHR137W | S. cerevisiae | 5974 | Cytoplasmic | 6023, 6024, 6025, 6026 |
| 1 | 66 | NUE_OEX_1 | YHR137W | S. cerevisiae | 5974 | Plastidic | 6023, 6024, 6025, 6026 |
| 1 | 67 | NUE_OEX_1 | YIL099W | S. cerevisiae | 6028 | Cyto-plasmictidic | 6101, 6102, 6103, 6104, 6105, 6106 |
| 1 | 67 | NUE_OEX_1 | YIL099W | S. cerevisiae | 6028 | Plastidic | 6101, 6102, 6103, 6104, 6105, 6106 |
| 1 | 68 | NUE_OEX_1 | YIL147C | S. cerevisiae | 6108 | Cytoplasmic | 6135, 6136, 6137, 6138, 6139, 6140, 6141, 6142, 6143, 6144, 6145, 6146, 6147, 6148, 6149 |
| 1 | 69 | NUE_OEX_1 | YIR034C | S. cerevisiae | 6151 | Cytoplasmic | 6188, 6189, 6190, 6191, 6192, 6193, 6194, 6195, 6196, 6197 |
| 1 | 70 | NUE_OEX_1 | YJL013C | S. cerevisiae | 6199 | Cytoplasmic | — |
| 1 | 71 | NUE_OEX_1 | YJL041W | S. cerevisiae | 6209 | Cytoplasmic | 6238, 6239, 6240, 6241 |
| 1 | 72 | NUE_OEX_1 | YJL064W | S. cerevisiae | 6243 | Cytoplasmic | — |
| 1 | 73 | NUE_OEX_1 | YJL067W | S. cerevisiae | 6247 | Cytoplasmic | — |
| 1 | 74 | NUE_OEX_1 | YJL094C | S. cerevisiae | 6251 | Cytoplasmic | 6288, 6289, 6290, 6291, 6292, 6293, 6294, 6295, 6296 |
| 1 | 75 | NUE_OEX_1 | YJL171C | S. cerevisiae | 6298 | Cytoplasmic | 6319, 6320, 6321, 6322, 6323, 6324, 6325 |
| 1 | 76 | NUE_OEX_1 | YJL213W | S. cerevisiae | 6327 | Cytoplasmic | 6484, 6485, 6486, 6487 |
| 1 | 77 | NUE_OEX_1 | YJR017C | S. cerevisiae | 6489 | Cytoplasmic | 6546, 6547, 6548, 6549 |
| 1 | 78 | NUE_OEX_1 | YJR058C | S. cerevisiae | 6551 | Cytoplasmic | 6698, 6699 |
| 1 | 79 | NUE_OEX_1 | YJR117W | S. cerevisiae | 6701 | Cytoplasmic | 6810, 6811, 6812, 6813, 6814, 6815 |
| 1 | 80 | NUE_OEX_1 | YJR121W | S. cerevisiae | 6817 | Cytoplasmic | 7352, 7353, 7354, 7355, 7356, 7357, 7358, 7359, 7360, 7361, 7362, 7363, 7364, 7365 |
| 1 | 81 | NUE_OEX_1 | YJR131W | S. cerevisiae | 7367 | Cytoplasmic | 7470, 7471, 7472, 7473, 7474 |
| 1 | 82 | NUE_OEX_1 | YJR145C | S. cerevisiae | 7476 | Cytoplasmic | 7599, 7600, 7601 |
| 1 | 83 | NUE_OEX_1 | YKL084W | S. cerevisiae | 7603 | Cytoplasmic | 7648, 7649, 7650 |
| 1 | 84 | NUE_OEX_1 | YKL088W | S. cerevisiae | 7652 | Cytoplasmic | 7657, 7658, 7659, 7660 |
| 1 | 85 | NUE_OEX_1 | YKL100C | S. cerevisiae | 7662 | Cytoplasmic | 7671, 7672, 7673, 7674 |
| 1 | 86 | NUE_OEX_1 | YKL131W | S. cerevisiae | 7676 | Cytoplasmic | — |
| 1 | 87 | NUE_OEX_1 | YKL138C | S. cerevisiae | 7680 | Cytoplasmic | 7707, 7708, 7709 |
| 1 | 88 | NUE_OEX_1 | YKL178C | S. cerevisiae | 7711 | Cytoplasmic | 7722, 7723, 7724, 7725, 7726, 7727, 7728, 7729, 7730, 7731, 7732, 7733, 7734 |
| 1 | 89 | NUE_OEX_1 | YKL179C | S. cerevisiae | 7736 | Cytoplasmic | 7771, 7772, 7773, 7774, 7775, 7776, 7777 |
| 1 | 90 | NUE_OEX_1 | YKL193C | S. cerevisiae | 7779 | Cytoplasmic | 7824, 7825, 7826, 7827, 7828 |
| 1 | 91 | NUE_OEX_1 | YKL216W | S. cerevisiae | 7830 | Cytoplasmic | 8015, 8016 |
| 1 | 92 | NUE_OEX_1 | YKR016W | S. cerevisiae | 8018 | Cytoplasmic | 8041, 8042, 8043, 8044 |
| 1 | 93 | NUE_OEX_1 | YKR021W | S. cerevisiae | 8046 | Cytoplasmic | 8063, 8064, 8065, 8066, 8067, 8068, 8069, 8070, 8071, 8072 |
| 1 | 94 | NUE_OEX_1 | YKR055W | S. cerevisiae | 8074 | Cytoplasmic | 8261, 8262 |
| 1 | 95 | NUE_OEX_1 | YKR088C | S. cerevisiae | 8264 | Plastidic | 8283, 8284, 8285, 8286 |
| 1 | 96 | NUE_OEX_1 | YKR093W | S. cerevisiae | 8288 | Cytoplasmic | 8465, 8466, 8467 |
| 1 | 97 | NUE_OEX_1 | YKR099W | S. cerevisiae | 8469 | Cytoplasmic | 8476, 8477, 8478, 8479, 8480, 8481, 8482, 8483 |
| 1 | 98 | NUE_OEX_1 | YKR100C | S. cerevisiae | 8485 | Cytoplasmic | — |
| 1 | 99 | NUE_OEX_1 | YLL014W | S. cerevisiae | 8493 | Cytoplasmic | 8512, 8513 |
| 1 | 100 | NUE_OEX_1 | YLL016W | S. cerevisiae | 8515 | Cytoplasmic | 8530, 8531, 8532, 8533, 8534, 8535, 8536, 8537, 8538 |
| 1 | 101 | NUE_OEX_1 | YLL023C | S. cerevisiae | 8540 | Cytoplasmic | 8569, 8570 |
| 1 | 102 | NUE_OEX_1 | YLL037W | S. cerevisiae | 8572 | Cytoplasmic | — |
| 1 | 103 | NUE_OEX_1 | YLL049W | S. cerevisiae | 8576 | Cytoplasmic | — |
| 1 | 104 | NUE_OEX_1 | YLL055W | S. cerevisiae | 8580 | Cytoplasmic | 8659, 8660 |
| 1 | 105 | NUE_OEX_1 | YLR034C | S. cerevisiae | 8662 | Cytoplasmic | 8985, 8986, 8987, 8988, 8989, 8990 |
| 1 | 106 | NUE_OEX_1 | YLR042C | S. cerevisiae | 8992 | Cytoplasmic | — |
| 1 | 107 | NUE_OEX_1 | YLR053C | S. cerevisiae | 8996 | Cytoplasmic | — |
| 1 | 108 | NUE_OEX_1 | YLR058C | S. cerevisiae | 9000 | Cytoplasmic | 9543, 9544, 9545, 9546, 9547, 9548, 9549, 9550 |
| 1 | 109 | NUE_OEX_1 | YLR060W | S. cerevisiae | 9552 | Cytoplasmic | 9631, 9632, 9633, 9634, 9635, 9636 |

TABLE IV-continued

Consensus amino acid sequence ID numbers

| Application | 1. Hit | 2. Project | 3. Locus | 4. Organism | 5. Lead SEQ ID | 6. Target | 7. SEQ IDs of Consensus/Pattern Sequences |
|---|---|---|---|---|---|---|---|
| 1 | 110 | NUE_OEX_1 | YLR065C | S. cerevisiae | 9638 | Cytoplasmic | 9671 |
| 1 | 111 | NUE_OEX_1 | YLR070C | S. cerevisiae | 9673 | Cytoplasmic | 10180, 10181 |
| 1 | 112 | NUE_OEX_1 | YLR100W | S. cerevisiae | 10183 | Cytoplasmic | 10206, 10207, 10208, 10209, 10210, 10211, 10212, 10213 |
| 1 | 113 | NUE_OEX_1 | YLR109W | S. cerevisiae | 10215 | Cytoplasmic | 10446 |
| 1 | 114 | NUE_OEX_1 | YLR125W | S. cerevisiae | 10448 | Cytoplasmic | — |
| 1 | 115 | NUE_OEX_1 | YLR127C | S. cerevisiae | 10452 | Cytoplasmic | — |
| 1 | 116 | NUE_OEX_1 | YLR185W | S. cerevisiae | 10464 | Cytoplasmic | 10529, 10530, 10531, 10532 |
| 1 | 117 | NUE_OEX_1 | YLR204W | S. cerevisiae | 10534 | Cytoplasmic | — |
| 1 | 117 | NUE_OEX_1 | YLR204W | S. cerevisiae | 10534 | Plastidic | — |
| 1 | 118 | NUE_OEX_1 | YLR242C | S. cerevisiae | 10542 | Cytoplasmic | 10557, 10558, 10559, 10560, 10561 |
| 1 | 119 | NUE_OEX_1 | YLR293C | S. cerevisiae | 10563 | Cytoplasmic | 10986, 10987, 10988, 10989 |
| 1 | 120 | NUE_OEX_1 | YLR313C | S. cerevisiae | 10991 | Cytoplasmic | — |
| 1 | 121 | NUE_OEX_1 | YLR315W | S. cerevisiae | 10999 | Cytoplasmic | — |
| 1 | 122 | NUE_OEX_1 | YLR329W | S. cerevisiae | 11005 | Cytoplasmic | — |
| 1 | 123 | NUE_OEX_1 | YLR362W | S. cerevisiae | 11013 | Cytoplasmic | 11046, 11047, 11048, 11049, 11050, 11051, 11052, 11053 |
| 1 | 124 | NUE_OEX_1 | YLR395C | S. cerevisiae | 11055 | Cytoplasmic | 11064, 11065 |
| 1 | 125 | NUE_OEX_1 | YLR404W | S. cerevisiae | 11067 | Cytoplasmic | — |
| 1 | 126 | NUE_OEX_1 | YLR463C | S. cerevisiae | 11075 | Cytoplasmic | — |
| 1 | 127 | NUE_OEX_1 | YML022W | S. cerevisiae | 11081 | Cytoplasmic | 11550, 11551 |
| 1 | 128 | NUE_OEX_1 | YML027W | S. cerevisiae | 11553 | Cytoplasmic | 11566, 11567, 11568 |
| 1 | 129 | NUE_OEX_1 | YML065W | S. cerevisiae | 11570 | Cytoplasmic | 11589, 11590, 11591, 11592, 11593, 11594, 11595 |
| 1 | 130 | NUE_OEX_1 | YML089C | S. cerevisiae | 11597 | Cytoplasmic | — |
| 1 | 131 | NUE_OEX_1 | YML128C | S. cerevisiae | 11601 | Cytoplasmic | — |
| 1 | 132 | NUE_OEX_1 | YMR011W | S. cerevisiae | 11613 | Cytoplasmic | 12244, 12245 |
| 1 | 133 | NUE_OEX_1 | YMR037C | S. cerevisiae | 12247 | Cytoplasmic | 12258, 12259, 12260, 12261, 12262 |
| 1 | 134 | NUE_OEX_1 | YMR049C | S. cerevisiae | 12264 | Cytoplasmic | 12301, 12302, 12303, 12304, 12305, 12306, 12307, 12308, 12309, 12310, 12311, 12312, 12313, 12314, 12315 |
| 1 | 135 | NUE_OEX_1 | YMR052W | S. cerevisiae | 12317 | Cytoplasmic | 12324, 12325, 12326 |
| 1 | 136 | NUE_OEX_1 | YMR082C | S. cerevisiae | 12328 | Cytoplasmic | — |
| 1 | 137 | NUE_OEX_1 | YMR125W | S. cerevisiae | 12332 | Cytoplasmic | 12369, 12370, 12371, 12372, 12373, 12374, 12375, 12376, 12377 |
| 1 | 138 | NUE_OEX_1 | YMR126C | S. cerevisiae | 12379 | Cytoplasmic | 12388, 12389, 12390, 12391, 12392, 12393 |
| 1 | 139 | NUE_OEX_1 | YMR144W | S. cerevisiae | 12395 | Cytoplasmic | 12402, 12403, 12404, 12405 |
| 1 | 140 | NUE_OEX_1 | YMR160W | S. cerevisiae | 12407 | Cytoplasmic | — |
| 1 | 141 | NUE_OEX_1 | YMR191W | S. cerevisiae | 12415 | Cytoplasmic | — |
| 1 | 142 | NUE_OEX_1 | YMR209C | S. cerevisiae | 12421 | Cytoplasmic | 12432, 12433, 12434, 12435, 12436, 12437, 12438, 12439 |
| 1 | 143 | NUE_OEX_1 | YMR233W | S. cerevisiae | 12441 | Cytoplasmic | 12468, 12469 |
| 1 | 144 | NUE_OEX_1 | YMR278W | S. cerevisiae | 12471 | Cytoplasmic | 12742, 12743, 12744, 12745, 12746, 12747, 12748 |
| 1 | 145 | NUE_OEX_1 | YMR280C | S. cerevisiae | 12750 | Cytoplasmic | 12759, 12760, 12761, 12762, 12763, 12764, 12765, 12766, 12767, 12768, 12769, 12770, 12771, 12772 |
| 1 | 146 | NUE_OEX_1 | YNL014W | S. cerevisiae | 12774 | Cytoplasmic | 12813, 12814, 12815, 12816, 12817, 12818, 12819, 12820, 12821, 12822, 12823, 12824, 12825, 12826, 12827, 12828 |
| 1 | 147 | NUE_OEX_1 | YNL320W | S. cerevisiae | 12830 | Cytoplasmic | 12877, 12878, 12879, 12880, 12881, 12882 |
| 1 | 148 | NUE_OEX_1 | YOL007C | S. cerevisiae | 12884 | Cytoplasmic | — |
| 1 | 149 | NUE_OEX_1 | YOL164W | S. cerevisiae | 12890 | Cytoplasmic | 13003, 13004, 13005, 13006, 13007, 13008, 13009, 13010, 13011, 13012, 13013 |
| 1 | 150 | NUE_OEX_1 | YOR076C | S. cerevisiae | 13015 | Cytoplasmic | — |
| 1 | 151 | NUE_OEX_1 | YOR083W | S. cerevisiae | 13019 | Cytoplasmic | — |
| 1 | 152 | NUE_OEX_1 | YOR097C | S. cerevisiae | 13025 | Cytoplasmic | — |
| 1 | 153 | NUE_OEX_1 | YOR128C | S. cerevisiae | 13031 | Cytoplasmic | 13102, 13103, 13104, 13105, 13106, 13107, 13108, 13109, 13110, 13111, 13112, 13113, 13114 |
| 1 | 154 | NUE_OEX_1 | YOR353C | S. cerevisiae | 14086 | Cytoplasmic | — |
| 1 | 155 | NUE_OEX_1 | YPL141C | S. cerevisiae | 14094 | Cytoplasmic | 14103, 14104, 14105, 14106, 14107, 14108, 14109, 14110, 14111, 14112 |
| 1 | 156 | NUE_OEX_1 | YPR088C | S. cerevisiae | 14114 | Cytoplasmic | 14237, 14238, 14239, 14240, 14241, 14242, 14243, 14244, 14245 |
| 1 | 157 | NUE_OEX_1 | YPR108W | S. cerevisiae | 14247 | Cytoplasmic | 14302, 14303, 14304, 14305, 14306, 14307, 14308, 14309, 14310 |
| 1 | 158 | NUE_OEX_1 | YPR110C | S. cerevisiae | 14312 | Cytoplasmic | 14385, 14386, 14387, 14388 |
| 1 | 159 | NUE_OEX_1 | B3825_2 | E. coli | 14915 | Plastidic | 15012, 15013 |
| 1 | 160 | NUE_OEX_1 | YIR034C_2 | S. cerevisiae | 15383 | Cytoplasmic | 15422, 15423, 15424, 15425, 15426, 15427, 15428, 15429, 15430, 15431 |
| 1 | 161 | NUE_OEX_1 | YJR131W_2 | S. cerevisiae | 15461 | Cytoplasmic | 15566, 15567, 15568, 15569, 15570 |
| 1 | 162 | NUE_OEX_1 | YKL100C_2 | S. cerevisiae | 15572 | Cytoplasmic | 15583, 15584, 15585, 15586 |
| 1 | 163 | NUE_OEX_1 | YKL193C_2 | S. cerevisiae | 15594 | Cytoplasmic | 15641, 15642, 15643, 15644, 15645 |
| 1 | 164 | NUE_OEX_1 | YLL016W_2 | S. cerevisiae | 15647 | Cytoplasmic | 15664, 15665, 15666, 15667, 15668, 15669, 15670, 15671, 15672 |
| 1 | 165 | NUE_OEX_1 | YLR034C_2 | S. cerevisiae | 15674 | Cytoplasmic | 15999, 16000, 16001, 16002, 16003, 16004 |
| 1 | 166 | NUE_OEX_1 | YLR060W_2 | S. cerevisiae | 16006 | Cytoplasmic | 16087, 16088, 16089, 16090, 16091, 16092 |
| 1 | 167 | NUE_OEX_1 | YMR082C_2 | S. cerevisiae | 16115 | Cytoplasmic | — |
| 1 | 168 | NUE_OEX_1 | B1258 | E. coli | 14403 | Cytoplasmic | 14494, 14495, 14496 |
| 1 | 169 | NUE_OEX_1 | YML101C | S. cerevisiae | 16094 | Cytoplasmic | 16103, 16104, 16105 |
| 1 | 170 | NUE_OEX_1 | YMR065W | S. cerevisiae | 16107 | Cytoplasmic | — |
| 1 | 171 | NUE_OEX_1 | YMR163C | S. cerevisiae | 16121 | Cytoplasmic | 16130, 16131, 16132 |

TABLE IV-continued

Consensus amino acid sequence ID numbers

| Application | 1. Hit | 2. Project | 3. Locus | 4. Organism | 5. Lead SEQ ID | 6. Target | 7. SEQ IDs of Consensus/Pattern Sequences |
|---|---|---|---|---|---|---|---|
| 1 | 172 | NUE_OEX_1 | YOL042W | S. cerevisiae | 16276 | Cytoplasmic | 16291, 16292, 16293, 16294, 16295, 16296, 16297, 16298 |
| 1 | 173 | NUE_OEX_1 | YOR226C | S. cerevisiae | 16306 | Cytoplasmic | 16569, 16570, 16571, 16572 |
| 1 | 174 | NUE_OEX_1 | YPL068C | S. cerevisiae | 16574 | Cytoplasmic | 16581 |
| 1 | 175 | NUE_OEX_1 | B0165 | E. coli | 14397 | Plastidic | — |
| 1 | 176 | NUE_OEX_1 | YOR203W | S. cerevisiae | 16300 | Cytoplasmic | — |
| 1 | 177 | NUE_OEX_1 | YNL147W | S. cerevisiae | 16134 | Cytoplasmic | 16273, 16274 |
| 1 | 178 | NUE_OEX_1 | YBR083W | S. cerevisiae | 15057 | Cytoplasmic | — |
| 1 | 179 | NUE_OEX_1 | YKL111C | S. cerevisiae | 15588 | Cytoplasmic | — |
| 1 | 180 | NUE_OEX_1 | YPR067W | S. cerevisiae | 16583 | Cytoplasmic | 16626, 16627, 16628 |
| 1 | 181 | NUE_OEX_1 | B1985 | E. coli | 14840 | Cytoplasmic | 14869, 14870, 14871, 14872, 14873, 14874, 14875, 14876, 14877, 14878 |
| 1 | 182 | NUE_OEX_1 | B3838 | E. coli | 15015 | Cytoplasmic | 15052, 15053, 15054, 15055 |
| 1 | 183 | NUE_OEX_1 | YJL010C | S. cerevisiae | 15433 | Cytoplasmic | 15452, 15453, 15454, 15455, 15456, 15457, 15458, 15459 |
| 1 | 184 | NUE_OEX_1 | B1267 | E. coli | 14498 | Cytoplasmic | 14715, 14716, 14717 |
| 1 | 185 | NUE_OEX_1 | B1322 | E. coli | 14719 | Cytoplasmic | 14788, 14789, 14790 |
| 1 | 186 | NUE_OEX_1 | B1381 | E. coli | 14792 | Cytoplasmic | 14823, 14824, 14825, 14826, 14827, 14828, 14829, 14830, 14831, 14832, 14833, 14834, 14835, 14836, 14837, 14838 |
| 1 | 187 | NUE_OEX_1 | B2646 | E. coli | 14880 | Cytoplasmic | 14911, 14912, 14913 |
| 1 | 188 | NUE_OEX_1 | YBR191W | S. cerevisiae | 15065 | Cytoplasmic | 15252, 15253, 15254, 15255, 15256 |
| 1 | 189 | NUE_OEX_1 | YDL135C | S. cerevisiae | 15258 | Cytoplasmic | 15375, 15376, 15377 |
| 1 | 190 | NUE_OEX_1 | YHL005C | S. cerevisiae | 15379 | Cytoplasmic | — |
| 1 | 191 | NUE_OEX_1 | YKR100C_2 | S. cerevisiae | 16630 | Cytoplasmic | 16641, 16642, 16643, 16644, 16645, 16646 |
| 1 | 192 | NUE_OEX_1 | YMR191W_2 | S. cerevisiae | 16648 | Cytoplasmic | — |

SEQUENCE LISTING (16680 sequences)

SEQ ID NO: 1 - DNA, 9045 bp, Artificial sequence
  VC-MME220-1
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 2 - DNA, 8883 bp, Artificial sequence
  VC-MME221-1
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 3 - DNA, 9469 bp, Artificial sequence
  VC-MME354-1
  CDS (2295)..(2404): FNR transit peptide
  CDS (2482)..(2545): FNR transit peptide
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattcgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctctgaattccagctgaccacccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 4 - protein, 58 aa, Artificial sequence
  Synthetic Construct
MTTAVTAAVSFPSTKTTSLSARSSSVISPDKISYKKVPLYYRNVSATGKMGPIRAQIA

SEQ ID NO: 5 - DNA, 9465 bp, Artificial sequence
  VC-MME432-1
  CDS (2290)..(2400): FNR transit peptide
  CDS (2478)..(2540): FNR transit peptide
gctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccaaacgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctcttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 6 - protein, 58 aa, Artificial sequence; identical to SEQ ID NO: 4
  Synthetic Construct

SEQ ID NO: 7 - DNA, 19 bp, Artificial sequence
  adapter sequence added to gene specific primers for cloning purposes
ggaattccagctgaccacc

SEQ ID NO: 8 - DNA, 20 bp, Artificial sequence
  adapter sequence added to gene specific primers for cloning purposes
gatccccgggaattgccatg

SEQ ID NO: 9 - DNA, 10 bp, Artificial sequence
  adapter sequence added to gene specific primers for cloning purposes
ttgctcttcc

SEQ ID NO: 10 - DNA, 10 bp, Artificial sequence
  adapter sequence added to gene specific primers for cloning purposes
ttgctcttcg

SEQ ID NO: 11 - DNA, 34 bp, Artificial sequence
  Amplification of the targeting sequence of the gene FNR from Spinacia oleracea to generate the S.cerevisiae plastidic targeting vector VC-MME354-1
atagaattcgcataaacttatcttcatagttgcc

SEQ ID NO: 12 - DNA, 27 bp, Artificial sequence
  Amplification of the targeting sequence of the gene FNR from Spinacia oleracea to generate the S.cerevisiae plastidic targeting vector VC-MME354-1
atagaattcagaggcgatctgggccct

SEQ ID NO: 13 - DNA, 36 bp, Artificial sequence
  Amplification of the targeting sequence of the gene FNR from Spinacia oleracea to generate the E.coli plastidic targeting vector VC-MME432-1
atagtttaaacgcataaacttatcttcatagttgcc

SEQ ID NO: 14 - DNA, 34 bp, Artificial sequence
  Amplification of the targeting sequence of the gene FNR from Spinacia oleracea to generate the E.coli plastidic targeting vector VC-MME432-1
ataccatggaagagcaagaggcgatctgggccct

SEQ ID NO: 15 - DNA, 9044 bp, Artificial sequence
  VC-MME489-1p
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattccagctgaccacccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 16 - DNA, 9041 bp, Artificial sequence
  pMTX0270p
gctttgggcggatccggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 17 - protein, 62 aa, Acetabularia mediterranea
MASIMMNKSVVLSKECAKPLATPKVTLNKRGFATTIATKNREMMVWQPFNNKMFETFSFLPP

SEQ ID NO: 18 - protein, 90 aa, Arabidopsis thaliana
MAASLQSTATFLQSAKIATAPSRGSSHLRSTQAVGKSFGLETSSARLTCSFQSDFKDFTGKCSDAVKIAGFALATSALVVSGASAEGAPK

SEQ ID NO: 19 - protein, 96 aa, Arabidopsis thaliana
MAQVSRICNGVQNPSLICNLSKSSQRKSPLSVSLKTQQHPRAYPISSSWGLKKSGMTLIGSELRPLKVMSSVSTAEKASEIVLQPIREISGLIKLP

SEQ ID NO: 20 - protein, 100 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGA

SEQ ID NO: 21 - protein, 46 aa, Arabidopsis thaliana
MITSSLTCSLQALKLSSPFAHGSTPLSSLSKPNSFPNHRMPALVPV

SEQ ID NO: 22 - protein, 93 aa, Arabidopsis thaliana
MASLLGTSSSAIWASPSLSSPSSKPSSSPICFRPGKLFGSKLNAGIQIRPKKNRSRYHVSVMNVATEINSTEQVVGKFDSKKSARPVYPFAAI

SEQ ID NO: 23 - protein, 52 aa, Arabidopsis thaliana
MASTALSSAIVGTSFIRRSPAPISLRSLPSANTQSLFGLKSGTARGGRVVAM

SEQ ID NO: 24 - protein, 39 aa, Arabidopsis thaliana
MAASTMALSSPAFAGKAVNLSPAASEVLGSGRVTNRKTV

SEQ ID NO: 25 - protein, 92 aa, Arabidopsis thaliana
MAAITSATVTIPSFTGLKLAVSSKPKTLSTISRSSSATRAPPKLALKSSLKDFGVIAVATAASIVLAGNAMAMEVLLGSDDGSLAFVPSEFT

SEQ ID NO: 26 - protein, 85 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQIDI

SEQ ID NO: 27 - protein, 54 aa, Arabidopsis thaliana
MKSSMLSSTAWTSPAQATMVAPFTGLKSSASFPVTRKANNDITSITSNGGRVSC

SEQ ID NO: 28 - protein, 91 aa, Arabidopsis thaliana
MAASGTSATFRASVSSAPSSSSQLTHLKSPFKAVKYTPLPSSRSKSSSFSVSCTIAKDPPVLMAAGSDPALWQRPDSFGRFGKFGGKYVPE

SEQ ID NO: 29 - protein, 80 aa, Brassica campestris
MSTTFCSSVCMQATSLAATTRISFQKPALVSTTNLSFNLRRSIPTRFSISCAAKPETVEKVSKIVKKQLSLKDDQKVVAE

SEQ ID NO: 30 - protein, 51 aa, Brassica napus
MATTFSASVSMQATSLATTTRISFQKPVLVSNHGRTNLSFNLSRTRLSISC

SEQ ID NO: 31 - protein, 44 aa, Chlamydomonas reinhardtii
MQALSSRVNIAAKPQRAQRLVVRAEEVKAAPKKEVGPKRGSLVK

SEQ ID NO: 32 - protein, 51 aa, Cucurbita moschata
MAELIQDKESAQSAATAAAASSGYERRNEPAHSRKFLEVRSEEELLSCIKK

SEQ ID NO: 33 - protein, 62 aa, Spinacea oleracea
MSTINGCLTSISPSRTQLKNTSTLRPTFIANSRVNPSSSVPPSLIRNQPVFAAPAPIITPTL

SEQ ID NO: 34 - protein, 75 aa, Spinacea oleracea
MTTAVTAAVSFPSTKTTSLSARCSSVISPDKISYKKVPLYYRNVSATGKMGPIRAQIASDVEAPPPAPAKVEKMS

SEQ ID NO: 35 - protein, 55 aa, Spinacea oleracea
MTTAVTAAVSFPSTKTTSLSARSSSVISPDKISYKKVPLYYRNVSATGKMGPIRA

SEQ ID NO: 36 - DNA, 419 bp, Spinacia oleracea
  5'UTR (1)..(168)
  CDS (166)..(273)
  CDS (351)..(419)
gcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctct

SEQ ID NO: 37 - protein, 59 aa, Spinacia oleracea
MTTAVTAAVSFPSTKTTSLSARSSSVISPDKISYKKVPLYYRNVSATGKMGPIRAQIAS

SEQ ID NO: 38 - DNA, 309 bp, Escherichia coli
  CDS (1)..(309): transl_table=11
atgccggaaagggagctccggcttttttattacctgaattgcctatcattacagtggtttcaccgttcttaccgcaatccagcccgcgcagaaaacccatcatgtcaaagcgcattccttctgcagttaaccagcgcaatcctcgccagtgaacccggacgatataatcagcttctccaaaagcaagtgagcggatacattcgggacgcgaaccgaatccccggtcagcaatgcgtatctcgtctgccgtttgcgcaaatcggtccagccgttcagcgtctctgctgtcggttagctcaaaatcagtaa

SEQ ID NO: 39 - protein, 102 aa, Escherichia coli
MPERELRLFYYLNCLSLQWFHRSYRNPARAENPSCQSAFLLQLTSAILASEPGRYNQLLQKQVSGYIRDANRIPGQQCVSRLPFAQIGPAVQRLCCRLAQNQ

SEQ ID NO: 40 - DNA, 21 bp, Artificial sequence
  primer
atgccggaaagggagctccgg

SEQ ID NO: 41 - DNA, 26 bp, Artificial sequence
  primer
ttactgattttgagctaaccgacagc

SEQ ID NO: 42 - DNA, 1332 bp, Escherichia coli
  CDS (1)..(1332): transl_table=11
atgcaaccgtccagaaactttgacgatctcaaattctcctctattcaccgccgcattttgctgtggggaagcggtggtccgtttctggatggttatgtactggtaatgattggcgtggcgctggagcaactgacgccggcgctgaaactggacgctgactggattggcttgctgggcgcgggaacgctcgccgggctgttcgttggcacatcgctgtttggttatatttccgataaagtcggacggcgcaaaatgttcctcattgatatcatcgccatcggcgtgatatcggtggcgacgatgtttgtttcatcccccgtcgaactgttggtgatgcgggtacttatcggcattgtcatcggtgcagattatcccatcgccacctcaatgatcaccgagttctccagtacccgtcagcgggcgttttccatcagctttattgccgcgatgtggtatgtcggcgcgacctgtgccgatctggtcggctactggctttatgatgtggaaggcggctggcgctggatgctgggtagcgcggcgatcccctgtttgttgattttgattggtcgattcgaactgcctgaatctccccgctggttattacgcaaagggcgagtaaaagagtgcgaagagatgatgatcaaactgtttggcgaaccggtggctttcgatgaagagcagccgcagcaaacccgttttcgcgatctgtttaatcgccgccattttccttttgttctgtttgttgccgccatctggacctgccaggtgatcccaatgttcgccatttacacctttggcccgcaaatcgttggtttgttgggattgggggttggcaaaaacgcggcactagggaatgtggtgattagcctgttctttatgctcggctgtattccgccgatgctgtggttaaacactgccggacggcgtccattgttgattggcagctttgccatgatgacgctggcgctggcggttttggggctaatcccggatatggggatctggctggtagtgatggcctttgcggtgtatgcctttttctctggcgggccgggtaatttgcagtggctctatcctaatgaactcttcccgacagatatccgcgcctctgccgtgggcgtgattatgtccttaagtcgtattggcaccattgtttcgacctgggcactaccgatctttatcaataattacggtatcagtaacacgatgctaatgggggcgggtatctcgctgtttggcttgttgatttccgtagcgtttgccccggagactcgagggatgtcactggcgcagaccagcaatatgacgatccgcgggcagagaatggggtaa

SEQ ID NO: 43 - protein, 443 aa, Escherichia coli
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFDEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 44 - DNA, 1329 bp, Pseudomonas aeruginosa PAO1
  CDS (1)..(1329): transl_table=11
atgacaaatcctacgacctcgatcgaagacgtacccctcaacgccttccaccggctgttgaccctgcgctccggcggcggctccttcgtcgacggctacgtgctgagcatcatcggcgtggcgatgctgcagatgaccgcggcattgcaactgagcagtttctggcagggcatgatcgccgcctcggcgctggtcggcatcttcttcggcggtttcctcggcggctggctgaccgaccgcctgggccgccgcaggctgttcttcgtcggccccagcctgttcgtcctcgcttccctggcgcagtacggggtcgactcggcggcggcgctgttcgtcctgcgcttcctgatcggcgtggcggtgggcatcgagtacccggtcgccaccgccttgctggtggagttcttgccgaagaagtatcgcggaccgcgcctggccaccctgaccatcctctggttcgccggcgccgccttcgcctacctggtcggcgacctgatcctgcgcagcggcggcgaggacgcctggcgcctggtactggccagcaccgcggcgatcggtgccgtgctgttcctgctacgcatcggcacccccgagtcgccgcgctggctgctgagcaagggccgcgacgcggacgcagaacgggtcatccgccaggtctacggagaagccttctcgctggagaacctgcccgaacaggcgctggaacggaaggtcaccatctggcacctgctctacgccggctacggcaagcgcatgctcttcgtcaccctgttctggacctgctcggtgatccccgtgttcgccgtctacgccttcgcgcccaaggtgctgctggcgctgaacctgaagggcgactgggcctcctacggttcggtggcgatcaccctgctgttcgtcatcggctgcatcatcgccacccgcctgatcaaccgcatcggccggcgctgcatgctgctgcacagcttcctctggtccggcctggcgctgctcgggctgggcgtcttccacgccggctcggaggcgaccatcctcggcctgttcggtgcctacgcgctgttcatcggcggcgcccaggtgctgcaactggtctacccgaacgaactgttccccaccgagatccgcgccttcgcggtcggcgtcggcacctcgttatcgcgcgtcggcgccgcggtgggcacctacctggtgccgctttccctggaaaccctgggtaccgcccagaccatgtacgccgccgcgctggtgaccctgctcgggctgctcgtgacctgggccctggcgccggaaacccgttcgctgaacctgcagcaggcggcttcgctcacctga

SEQ ID NO: 45 - protein, 442 aa, Pseudomonas aeruginosa PAO1
MTNPTTSIEDVPLNAFHRLLTLRSGGGSFVDGYVLSIIGVAMLQMTAALQLSSFWQGMIAASALVGIFFGGFLGGWLTDRLGRRRLFFVGPSLFVLASLAQYGVDSAAALFVLRFLIGVAVGIEYPVATALLVEFLPKKYRGPRLATLTILWFAGAAFAYLVGDLILRSGGEDAWRLVLASTAAIGAVLFLLRIGTPESPRWLLSKGRDADAERVIRQVYGEAFSLENLPEQALERKVTIWHLLYAGYGKRMLFVTLFWTCSVIPVFAVYAFAPKVLLALNLKGDWASYGSVAITLLFVIGCIIATRLINRIGRRCMLLHSFLWSGLALLGLGVFHAGSEATILGLFGAYALFIGGAQVLQLVYPNELFPTEIRAFAVGVGTSLSRVGAAVGTYLVPLSLETLGTAQTMYAAALVTLLGLLVTWALAPETRSLNLQQAASLT

SEQ ID NO: 46 - DNA, 1410 bp, Escherichia coli O157:H7 EDL933
  CDS (1)..(1410): transl_table=11
atgatggggcgttgccttttcggcttctcaggcgagaagccgttcttattaccggacaatgaaggggtaaagatgaacacttcaccggtgcgaatggatgatttaccgcttaaccgttttcactgtcgaattgctgcgctcactttcggcgcacacctgaccgacggttatgttctcggcgtcattggttacgccattattcaacttacgcccgccatgcaactgacgccgtttatggcgggaatgatcggcggctcggcgcaccttggtttgtttcttggcagcctggttcttgggtggatctccgaccatattggtcggcaaaaaatcttcaccttcagctttttgctgattacgctcgcttcgttcttgcaattttttgccaccacgccagagcatcttattggactgcgcattttgatcggcattggtctgggaggcgattactcagtaggtcacaccttgctggctgaattttccccgcgccgccatcgcggtgttttgctgggcgcattcagcgtggtgtggaccgtaggctatgtgttggcaagtattgccggacatcactttatttccgaaaacccggaggcctggcgctggctgctggcatcggcagctctgcccgcgttgttgattacgttattacgctggggaacgccagaatcgccacgctggctactgcgccaggggcgttttgcagaagctcacgctatcgtgcatcgctattttggtccccatgttttactgggcgatgaagtggcaacggcgacccataaacacatcaaaaccttgttctcttcgcgctactggcggcgcacggcgtttaacagcgtcttctttgtctgcctcgtaatcccatggtttgtgatttatacctggctgccaactatcgcccagactattggactggaagatgcgctgactgccagcctgatgcttaatgcgttgttaattgtgggcgcgctgctgggattagttctgacgcacctgctggcacatcgcaaatttttgctgggaagttttttgctgctggcggcaacgctggtagtgatggcctgtttgccttccggcagttcattaacgctgctgctttttgttctcttcagcaccaccatttcggcagtcagtaatctggtgggcattttgcctgcggaaagttttcctactgacattcgctcgctgggcgtcggttttgccaccgccatgagtcggttgggggcggcggtaagtactggcctgctgccgtgggtgctggcgcagtggggaatgcaagtcaccttattgctcctggcggcagtgttgttggctggttttgttgtaacctggctatgggcaccagaaaccaaagcactcccgctggtggcggcgggaaatgtaggaggtgcgaatgaacattctgttagcgtttaa

SEQ ID NO: 47 - protein, 469 aa, Escherichia coli O157:H7 EDL933
MMGRCLFGFSGEKPFLLPDNEGVKMNTSPVRMDDLPLNRFHCRIAALTFGAHLTDGYVLGVIGYAIIQLTPAMQLTPFMAGMIGGSAHLGLFLGSLVLGWISDHIGRQKIFTFSFLLITLASFLQFFATTPEHLIGLRILIGIGLGGDYSVGHTLLAEFSPRRHRGVLLGAFSVVWTVGYVLASIAGHHFISENPEAWRWLLASAALPALLITLLRWGTPESPRWLLRQGRFAEAHAIVHRYFGPHVLLGDEVATATHKHIKTLFSSRYWRRTAFNSVFFVCLVIPWFVIYTWLPTIAQTIGLEDALTASLMLNALLIVGALLGLVLTHLLAHRKFLLGSFLLLAATLVVMACLPSGSSLTLLLFVLFSTTISAVSNLVGILPAESFPTDIRSLGVGFATAMSRLGAAVSTGLLPWVLAQWGMQVTLLLLAAVLLAGFVVTWLWAPETKALPLVAAGNVGGANEHSVSV

SEQ ID NO: 48 - DNA, 1380 bp, Thermoplasma acidophilum DSM 1728
  CDS (1)..(1380): transl_table=11
atgatatcctcaatgactgaatcatgggaggaattaaaagaaagagcttatggcccaatggacaaacaaaaatcaaaatggttcaactataaaatgctattattgactggaggtggcatattcgttgatggatacaatatagtcatcatatccttcggtttagcaggaatagaaacactgttcggtctacaacacaatgcttttttagttgggctcataggaatatcggtgattatagggaatttagtaggagccttgctttcaggttattttgtcgacaaggtcggaaggcgaacgatatttataattgatcttatattatttgtattttttgcaataatatccgggctagtgacaaatgcatacgaactcgtagtagcgcgcctcttggtaggtttaggaataggattagattatccaatagccacttcatatctcagtgaatataccccaattaatccaaggggaaaattcttggtcatgaatataacattcttcaatattgcaggagttgttgcagctatagttggatactcactcttgccattgggtgcaacgattgcctggagatatatgttaatgtctgctgcagttccagccgccattacaatagctggaagaatacgaactccagaatctccaagatggttacttgagcatggaaggaaaaaagaagctatacaggccattgaaagagtaacagagagcaccttgccagatgatacccaaaaattcataatggattccaacgtaaaaccaccggtatcaggctattataaagagcttcttacgaaatatactaaaagtgcaattttcataggtcttttctatttcttcttcgcaattgcatttgtaaacgcctctttgtatgggccttcaatccttgcatcctttggagaagctggtcttatcggttcttcattatattggttgcttttcgtcgtaggagacatcatctgtatactagtaatcgattcatttggtcgaagaaattctacgctaacaggctgggctggtatgctgataactatgataatcttagccttcgctccatcaaatctaaaattactttctcttggtgcatttatactatttgcaatgttccagggtatagggcctggtagtcttcatatggtatattctccagagctctttccaaccagaatcagagccactgcggagggatggaaacaaggtataggtagattaggtggagtgcttacaggtctgttcttcccaagtctggtgataggagataagctgttaatattaattctaacctctatagctggacttgtattatcaatactgatggctccagaaactaagagaaaagggctggaagagatttcagaaaaagacataaaccttcagatataa

SEQ ID NO: 49 - protein, 459 aa, Thermoplasma acidophilum DSM 1728
MISSMTESWEELKERAYGPMDKQKSKWFNYKMLLLTGGGIFVDGYNIVIISFGLAGIETLFGLQHNAFLVGLIGISVIIGNLVGALLSGYFVDKVGRRTIFIIDLILFVFFAIISGLVTNAYELVVARLLVGLGIGLDYPIATSYLSEYTPINPRGKFLVMNITFFNIAGVVAAIVGYSLLPLGATIAWRYMLMSAAVPAAITIAGRIRTPESPRWLLEHGRKKEAIQAIERVTESTLPDDTQKFIMDSNVKPPVSGYYKELLTKYTKSAIFIGLFYFFFAIAFVNASLYGPSILASFGEAGLIGSSLYWLLFVVGDIICILVIDSFGRRNSTLTGWAGMLITMIILAFAPSNLKLLSLGAFILFAMFQGIGPGSLHMVYSPELFPTRIRATAEGWKQGIGRLGGVLTGLFFPSLVIGDKLLILILTSIAGLVLSILMAPETKRKGLEEISEKDINLQI

SEQ ID NO: 50 - DNA, 1164 bp, Salmonella enterica subsp. enterica serovar Typhi str. CT18
  CDS (1)..(1164): transl_table=11
atgccgcagcccaggaactttgacgaccttaaattctcctccatccatcgcagaattatgctgtggggaagcggcggcccgttccttgatggctacgtgctggtgatcattggcgtggcgctggaacaactgacgccgctattgcaccttgatgctgaatggattggcgcgctcggcgcggctacgcttgccggactgtttatcggcacctcgttgtttggctatatttgcgataaagtcgggcggcgtaaaatgttcctgcttgatattatcgctatcggcgttatctccgtggcgaccatgtttgtttccacgccgcttgaattgctggtgatgcgcgttttaattggcattgttatcggcgcggattaccctatcgccacttccatgattacggagttttccaacacccgccagcgtgcgttctccatcggttttatcgccgcgatgtggtacgtcggcgcgacctgcgccaacctggtgggttactggctgtatgacatggaaggaggctggcgctggatgcttggcagcgcctttatcccgtgcttaatcattttgattggccgctttgacctgccggaatcgccacgctggctattgcgaaaaggacgggtaaaagagtgcgaacaaatgatgatcaaactgttcggcgaaccggtctgctttgacgatgagccgccgcaggagacccgcttcctgcagctgtttaaccgccgtcatttcccgtttgtactgttcgttgcggctatctggagctgtcaggtgatcccgatgttcgctatctatacctttgggccgcagatcgtcgggttactcggctgggaacaggggcgcaacgcggcgctcggcaatgtggtgattagcctcttttttatgctgggctgtataccggcgatgttctggctaaacagtattggccgtcgccctctgcttattggcagcttcgccatgatgactatcgcgctggcgctgctggggctggtgtcaaatctgggtatcatactggtcgtggtggcgtttgcggtatacgccttcttttccggcggaccgggcatactgcaatggctttatcctaatgaactcttccctacggatattcgcgcttcggccgtgggggtcatcatgtcattaagccgtatcggaaccattgtctccacctag

SEQ ID NO: 51 - protein, 387 aa, Salmonella enterica subsp. enterica serovar Typhi str. CT18
MPQPRNFDDLKFSSIHRRIMLWGSGGPFLDGYVLVIIGVALEQLTPLLHLDAEWIGALGAATLAGLFIGTSLFGYICDKVGRRKMFLLDIIAIGVISVATMFVSTPLELLVMRVLIGIVIGADYPIATSMITEFSNTRQRAFSIGFIAAMWYVGATCANLVGYWLYDMEGGWRWMLGSAFIPCLIILIGRFDLPESPRWLLRKGRVKECEQMMIKLFGEPVCFDDEPPQETRFLQLFNRRHFPFVLFVAAIWSCQVIPMFAIYTFGPQIVGLLGWEQGRNAALGNVVISLFFMLGCIPAMFWLNSIGRRPLLIGSFAMMTIALALLGLVSNLGIILVVVAFAVYAFFSGGPGILQWLYPNELFPTDIRASAVGVIMSLSRIGTIVST

SEQ ID NO: 52 - DNA, 1341 bp, Salmonella typhimurium LT2
  CDS (1)..(1341): transl_table=11
atgcagcagcccaggaactttgatgaccttaaattctcctccattcatcgcagaattatgctgtggggaagcggcggcccgttccttgatggctacgtgctggtgatcattggcgtggcgctggaacaactgacgccgctattgcaccttgatgctgaatggattggcgcgctcggcgcggctacgcttgccggactgtttatcggcacctcgttgtttggctatatttgcgataaagtcgggcggcgtaaaatgttcctgcttgatattatcgctatcggcgttatctccgtggcgaccatgtttgtttccacgccgcttgaattactggtgatgcgcgttttaattggcattgttatcggcgcggattaccctatcgctacttccatgattacggagttttccaacacccgccagcgcgcgttctccatcggttttatcgccgcgatgtggtacgtcggcgcgacctgcgccaacctggtgggctactggctgtatgacatggaaggcggctggcgttggatgcttggcagcgcctttatcccgtgcttaatcattttgattggccgctttgacctgccggaatcgccacgctggctattgcgaaaaggacgggtaaaagagtgcgaacaaatgatgatcaaactgttcggcgaaccggtctgctttgacgatgagctgccgcaggagacccgcttcctgcagctgtttaaccgccgtcatttcccgtttgtactgttcgttgcggctatctggacctgtcaggtgatcccgatgttcgctatctatacctttgggccgcagatcgtcgggttactcggctgggagcaggggcgcaacgcggcgcttggcaatgtggtgattagcctcttttttatgctgggctgtataccggcgatgttctggctaaacagtattggccgtcgccctctgcttattggcagcttcgccatgatgactatcgcgctggcgctgctggggctggtgtcaaatctgggcatcatactggtcgtggtggcgtttgcggtatacgccttcttttccggcggaccgggcatactgcaatggctttatcctaatgaactcttcccgacggatattcgcgcttcggccgtgggggtcatcatgtcattaagccgcatcggaaccattgtctccacctgggcattaccgatttttattactcgttacggtattaataacgtcatgctgattggcgcgttgatttcgttagtcgggcttggcgtatcggtgatgtttgccccggaaacccgcggcttgacgctaacacagaccggaaacatgactttgcgcggaacgccatcggataaccctcgttaa

SEQ ID NO: 53 - protein, 446 aa, Salmonella typhimurium LT2
MQQPRNFDDLKFSSIHRRIMLWGSGGPFLDGYVLVIIGVALEQLTPLLHLDAEWIGALGAATLAGLFIGTSLFGYICDKVGRRKMFLLDIIAIGVISVATMFVSTPLELLVMRVLIGIVIGADYPIATSMITEFSNTRQRAFSIGFIAAMWYVGATCANLVGYWLYDMEGGWRWMLGSAFIPCLIILIGRFDLPESPRWLLRKGRVKECEQMMIKLFGEPVCFDDELPQETRFLQLFNRRHFPFVLFVAAIWTCQVIPMFAIYTFGPQIVGLLGWEQGRNAALGNVVISLFFMLGCIPAMFWLNSIGRRPLLIGSFAMMTIALALLGLVSNLGIILVVVAFAVYAFFSGGPGILQWLYPNELFPTDIRASAVGVIMSLSRIGTIVSTWALPIFITRYGINNVMLIGALISLVGLGVSVMFAPETRGLTLTQTGNMTLRGTPSDNPR

SEQ ID NO: 54 - DNA, 1329 bp, Ralstonia solanacearum GMI1000
  CDS (1)..(1329): transl_table=11
gtggcaaacaacgtttctatcgaagacgttcctttgaatggcttccatcaactgctcagcattcgatccggcggcggctgggtcctggacggctacgtactgagcatcatcggcgtggccatggtgcagttgtcggcggcgctgcatttgagcggcttctggcaaggcatggttgcggcctcggccttgatcgggattttctgcggaggcttcctgggcgggctgctgaccggatgcctgggccgccagaagctgtacttcttcggtccgacgattttcgtggtgtgctcgctggcgcagttctgggcggattccggcgcggcgctgttcttcttccgattcctgatcggggtcggtgtcgggttcgaatacccggttgcgggttccttgctggtggagttcatgcccaggaaagatcgaggcccgcgcttggcgatgctgaccatcctgtggttcgccggtgcggcgctggcttacatggtgggcaacgcgatcctggataccgggcgtgccgacgcatggagactggtcctcgcaagcccggccgtcatcggcgcactgctgttgctggtgcgcatcgggacgccagagtcgcctcgctggctgttgagcaaagggcgggcagcggaggccgagcgcgtcatccagcaggtctatggcccccagttttcgctcgagaatcttcccgaacaacggccggagaagaaggtgtcgctcctgagcctgctgcactccgggtacggcaagcgcatgctgttcgtgtcggtcttctggagctgctcggtgattcccgtgtttgccgtgtacgcattcgcgcccacggtactgcaggcgttgcatctgaaaggggcctgggcgtcgttcggctccgtggccatcacgctgctgttcgtggtcggctgtttcgtcgccacgcggctgatcaataccgtcggccgccgcagcatgctcatccatagcttcctgtggtcggggctggcgctgctgggattgggcctcttctgcgacggctcggaaatgctggtgctcgtgctgttcggtgcctatgccgtgtttatcggcggtgcgcaggtattgcagctggtctatccgaatgagctgtttcccaccgaaatccggtcggccgcggtgggcatgggggcctcgctgtcgcgcatcggcgcagccattggaacgtgggcggtccccgtcgcgctgcagggcattggtgtcggcaacacgatgttcgcggcggccggggtgacgctgttcggcctgctggtgtcactggccatcgccccggaaacgcgcgcgctcagcttgcaggaggcggcttcgctcagtcgctag

SEQ ID NO: 55 - protein, 442 aa, Ralstonia solanacearum GMI1000
MANNVSIEDVPLNGFHQLLSIRSGGGWVLDGYVLSIIGVAMVQLSAALHLSGFWQGMVAASALIGIFCGGFLGGLLTGCLGRQKLYFFGPTIFVVCSLAQFWADSGAALFFFRFLIGVGVGFEYPVAGSLLVEFMPRKDRGPRLAMLTILWFAGAALAYMVGNAILDTGRADAWRLVLASPAVIGALLLLVRIGTPESPRWLLSKGRAAEAERVIQQVYGPQFSLENLPEQRPEKKVSLLSLLHSGYGKRMLFVSVFWSCSVIPVFAVYAFAPTVLQALHLKGAWASFGSVAITLLFVVGCFVATRLINTVGRRSMLIHSFLWSGLALLGLGLFCDGSEMLVLVLFGAYAVFIGGAQVLQLVYPNELFPTEIRSAAVGMGASLSRIGAAIGTWAVPVALQGIGVGNTMFAAAGVTLFGLLVSLAIAPETRALSLQEAASLSR

SEQ ID NO: 56 - DNA, 1410 bp, Shigella flexneri 2a str. 301
  CDS (1)..(1410): transl_table=11
atgacggggcgttgccttttcggcttctcaggcgagaagccgttcttattaccggacaatgaaggggtaaagatgaacacttcaccggtgcgaatggatgatttaccgcttaaccgttttcactgtcgaattgctacgctcactttcggcgcacacctgaccgacggttatgttctaggcgtcattggttacgccattattcaacttacgcccgccatgcaactgacgccgtttatggcgggaatgatcggcggctcggcgctccttggtttgtttcttggcagcctggttcttgggtggatctccgaccatattggtcggcaaaaaatcttcaccttcagctttttgctgattacgctcgcttcgttcttgcaattttttgccaccacgccagagcatcttattgggctgcgcattttgatcggcattggtctgggaggcgattactcagtaggtcacaccttgctggctgaattttccccgcgccgccatcgcggtattttgctgggcgcattcagcgtggtgtggaccgtaggctatgtgttggcaagtattgccggacatcactttatttccgaaaacccggaggcctggcgctggttgctggcatcggcagctctgcccgcgttgttgattacgttattacgctggggaacgccagaatcgccacgttggctactgtgccaggggcgttttgcagaagctcacgctatcgtgcatcgctattttggtccccatgttttactgggcgatgaagtggtaacggcgacccataaacacatcaaaaccttgttctcttcgcgttactggcggcgcacggcgtttaacagcgtcttctttgtctgcctcgtaatcccatggtttgtgatttatacctggctgccaactatcgcccagactattggtctggaagatgcgctgactgccagcctgatgcttaatgcgttgttaattgtgggcgcgctgctgggattagttctgacgcacctgctggcacatcgcaaatttttgctgggaagttttttgctgctggcggcaacgctggtagtaatggcctgtttgccttccggcagttcattaacgctgctgctttttgttctcttcagcaccaccatttcggcagtcagtaatctggtgggcattttgcctgcggaaagttttcctactgacattcgctcgctgggagtcggttttgccaccgccatgagtcgacttggcgcggcggtaagtactggcctgctgccgtgggtgctggcgcagtggggaatgcaagtcaccttattgctcctagcgacagtgttgttggttggttttgttgtgacctggctatgggcaccagaaactaaagccctcccgctggtggcggcgggaaatgtaggaggtgcgaatgaacattctgttagcgtttaa

SEQ ID NO: 57 - protein, 469 aa, Shigella flexneri 2a str. 301
MTGRCLFGFSGEKPFLLPDNEGVKMNTSPVRMDDLPLNRFHCRIATLTFGAHLTDGYVLGVIGYAIIQLTPAMQLTPFMAGMIGGSALLGLFLGSLVLGWISDHIGRQKIFTFSFLLITLASFLQFFATTPEHLIGLRILIGIGLGGDYSVGHTLLAEFSPRRHRGILLGAFSVVWTVGYVLASIAGHHFISENPEAWRWLLASAALPALLITLLRWGTPESPRWLLCQGRFAEAHAIVHRYFGPHVLLGDEVVTATHKHIKTLFSSRYWRRTAFNSVFFVCLVIPWFVIYTWLPTIAQTIGLEDALTASLMLNALLIVGALLGLVLTHLLAHRKFLLGSFLLLAATLVVMACLPSGSSLTLLLFVLFSTTISAVSNLVGILPAESFPTDIRSLGVGFATAMSRLGAAVSTGLLPWVLAQWGMQVTLLLLATVLLVGFVVTWLWAPETKALPLVAAGNVGGANEHSVSV

SEQ ID NO: 58 - DNA, 1410 bp, Escherichia coli CFT073
  CDS (1)..(1410): transl_table=11
atgacggggcgttgccttttcggcttctcaggcgagaagccgttcttattaccggacaatgaaggggtaaagatgaacacttcaccggtgcgaatggatgatttaccgcttaaccgttttcactgtcgaattgctgcgctcactttcggcgcacacctgaccgacggttatgtcctcggcgttattggttacgccattattcagcttacgcccgccatgcaactgacgccgtttatggcgggaatgatcggcggctcggcgttacttggtttgtttcttggcagcctggttttggggtggatctccgaccatatcgggcggcaaaaaatcttcaccttcagttttatgctgattacgctcgcttcgttcttgcaattttttgccaccacgccagagcatcttattggattgcgcattttgatcggcattggtctgggaggcgattactcagtcggtcacaccttgctggctgaattttccccgcgccgccatcgcggtattttgctgggcgcattcagtgtggtgtggaccgtaggctatgtgctggcaagtattgccggacatcactttatttccgaaagcccggaggcctggcgctggctgctggcatcagcagcgttaccagccttgctgattacgctgctacgttggggcacgccggaatcgccacgctggctactgcgccaggggcgttttgcagaagctcacgctatcgttcatcgctattttggcccgcatgttttactgggcgatgaagtggcaacggcgacccataaacacatcaaaaccttgttctcttcgcgctactggcggcgcacggcgtttaacagcgtcttctttgtctgcctcgtaatcccatggtttgtgatttatacctggctgccgaccatcgcccaaactattggtctggaagatgcgctgactgccagcctgatgcttaatgcgttgttaattgttggcgcgttattagggttagtgttgacccacttgttagcgcatcgcagatttttactgggaagttttttgctgctaacggcaacgctggtagtaatggcctgtttgccttccggcagttcattaacgctgctgctttttgttctcttcagcaccaccatttcggcagtcagtaatctggtgggcattttgcctgcggaaagttttcctactgacattcgctcgctgggcgtcggttttgccaccgccatgagtcggttgggggcggcggtaagtactggcctgctgccgtgggtgctggcgcagtggggaatgcaagccaccttattgctcctggcggcagtgttgttggttggttttgttgtgacctggctatgggcaccagaaaccaaagcactcccgctggtggcggcgggaaatgtaggaggtgcgaatgaacattctgttagcgtttaa

SEQ ID NO: 59 - protein, 469 aa, Escherichia coli CFT073
MTGRCLFGFSGEKPFLLPDNEGVKMNTSPVRMDDLPLNRFHCRIAALTFGAHLTDGYVLGVIGYAIIQLTPAMQLTPFMAGMIGGSALLGLFLGSLVLGWISDHIGRQKIFTFSFMLITLASFLQFFATTPEHLIGLRILIGIGLGGDYSVGHTLLAEFSPRRHRGILLGAFSVVWTVGYVLASIAGHHFISESPEAWRWLLASAALPALLITLLRWGTPESPRWLLRQGRFAEAHAIVHRYFGPHVLLGDEVATATHKHIKTLFSSRYWRRTAFNSVFFVCLVIPWFVIYTWLPTIAQTIGLEDALTASLMLNALLIVGALLGLVLTHLLAHRRFLLGSFLLLTATLVVMACLPSGSSLTLLLFVLFSTTISAVSNLVGILPAESFPTDIRSLGVGFATAMSRLGAAVSTGLLPWVLAQWGMQATLLLLAAVLLVGFVVTWLWAPETKALPLVAAGNVGGANEHSVSV

SEQ ID NO: 60 - DNA, 1341 bp, Salmonella enterica subsp. enterica serovar Typhi Ty2
  CDS (1)..(1341): transl_table=11
atgccgcagcccaggaactttgacgaccttaaattctcctccatccatcgcagaattatgctgtggggaagcggcggcccgttccttgatggctacgtgctggtgatcattggcgtggcgctggaacaactgacgccgctattgcaccttgatgctgaatggattggcgcgctcggcgcggctacgcttgccggactgtttatcggcacctcgttgtttggctatatttgcgataaagtcgggcggcgtaaaatgttcctgcttgatattatcgctatcggcgttatctccgtggcgaccatgtttgtttccacgccgcttgaattgctggtgatgcgcgttttaattggcattgttatcggcgcggattaccctatcgccacttccatgattacggagttttccaacacccgccagcgtgcgttctccatcggttttatcgccgcgatgtggtacgtcggcgcgacctgcgccaacctggtgggttactggctgtatgacatggaaggaggctggcgctggatgcttggcagcgcctttatcccgtgcttaatcattttgattggccgctttgacctgccggaatcgccacgctggctattgcgaaaaggacgggtaaaagagtgcgaacaaatgatgatcaaactgttcggcgaaccggtctgctttgacgatgagccgccgcaggagacccgcttcctgcagctgtttaaccgccgtcatttcccgtttgtactgttcgttgcggctatctggagctgtcaggtgatcccgatgttcgctatctatacctttgggccgcagatcgtcgggttactcggctgggaacaggggcgcaacgcggcgctcggcaatgtggtgattagcctcttttttatgctgggctgtataccggcgatgttctggctaaacagtattggccgtcgccctctgcttattggcagcttcgccatgatgactatcgcgctggcgctgctggggctggtgtcaaatctgggtatcatactggtcgtggtggcgtttgcggtatacgccttcttttccggcggaccgggcatactgcaatggctttatcctaatgaactcttccctacggatattcgcgcttcggccgtgggggtcatcatgtcattaagccgtatcggaaccattgtctccacctgggcattaccgatttttattactcgttacggtattaataacgtcatgctgattggcgcgttgatttcgttagtcgggcttggcgtatcggtgatgtttgccccggaaactcgcggcttgacgctaacacagaccggaaacatgactttgcgcggaacgccatcggataaccctcgttaa

SEQ ID NO: 61 - protein, 446 aa, Salmonella enterica subsp. enterica serovar Typhi Ty2
MPQPRNFDDLKFSSIHRRIMLWGSGGPFLDGYVLVIIGVALEQLTPLLHLDAEWIGALGAATLAGLFIGTSLFGYICDKVGRRKMFLLDIIAIGVISVATMFVSTPLELLVMRVLIGIVIGADYPIATSMITEFSNTRQRAFSIGFIAAMWYVGATCANLVGYWLYDMEGGWRWMLGSAFIPCLIILIGRFDLPESPRWLLRKGRVKECEQMMIKLFGEPVCFDDEPPQETRFLQLFNRRHFPFVLFVAAIWSCQVIPMFAIYTFGPQIVGLLGWEQGRNAALGNVVISLFFMLGCIPAMFWLNSIGRRPLLIGSFAMMTIALALLGLVSNLGIILVVVAFAVYAFFSGGPGILQWLYPNELFPTDIRASAVGVIMSLSRIGTIVSTWALPIFITRYGINNVMLIGALISLVGLGVSVMFAPETRGLTLTQTGNMTLRGTPSDNPR

SEQ ID NO: 62 - DNA, 1296 bp, Picrophilus torridus DSM 9790
  CDS (1)..(1296): transl_table=11
atggaaagcgtttcctttgatgaaataccggccagcagaaaattgttaaagataacgctgttatcatcagccggtgttataatggatggctatgttttaagcatatatgcagtggccttattgtatttaaaaaactattttatgccattgccgtatcaaatatcattaatggcatcttccgcgcttcttggaatgttctttggatcactaacgtttggttatttatctgacagattcgggcggaaaaaaatatatgaatacgaccttttaataacatcggtatttttgttcttaacagggttatcaaggaacgttattgaattcataatctttgaggtacttgcaggaataggcataggcgcggattatcctataagctcgtcgatacaggcagagttctcaccgagaaacgtcaggggtaaatatcttatatacaatatattcaactggaatattggctttatagccttttacatcgtttcaatattctttgtgctttatacaggattaaatgcctggaggtacatgtacataagtgctgcggcaataccgttgatcgttgtgcttttaaggagatcaatgccagagtcaccatactatttaataaaatcaggccattatgaatctgcaattaaagtagaaaatgaattttataaaaacgtaaaaaatccatatgtaaacggtggcagaacggaaataagggaattgttcagcaaaaagtatctaaaatacacaatctttgtttcaattgcatggttctcatacgacgttgcaagctatggaatatggacttatacaccatctctgttttctgacacgtcatcatatataatcagcgttcttggttctcttcttgaggaggttcctgtcatactcggtttcatcgttctatggtatttgatagagcgtgccggcagaagaagaatggagatcattggttttcttctgcctttaataccaatgctattactttatttcaccggcagcatgggctttttaatactattttttatgttcggatttatgcatttttcacataatcttggtcctggagaattaacatttacataccctgttgagatctttccaacaagaataaggtcaacggccatgggctttgcaacactatcatcaagaataggtgcaattcttggtgttgttgcatttccagtaataatgtacagctttggttttaaatactcaatgctcttctttgcagtttttgagattattggtcttattgttacagtaagatatgcaccagaaaccaagaagaaacctcttgatgccatatga

SEQ ID NO: 63 - protein, 431 aa, Picrophilus torridus DSM 9790
MESVSFDEIPASRKLLKITLLSSAGVIMDGYVLSIYAVALLYLKNYFMPLPYQISLMASSALLGMFFGSLTFGYLSDRFGRKKIYEYDLLITSVFLFLTGLSRNVIEFIIFEVLAGIGIGADYPISSSIQAEFSPRNVRGKYLIYNIFNWNIGFIAFYIVSIFFVLYTGLNAWRYMYISAAAIPLIVVLLRRSMPESPYYLIKSGHYESAIKVENEFYKNVKNPYVNGGRTEIRELFSKKYLKYTIFVSIAWFSYDVASYGIWTYTPSLFSDTSSYIISVLGSLLEEVPVILGFIVLWYLIERAGRRRMEIIGFLLPLIPMLLLYFTGSMGFLILFFMFGFMHFSHNLGPGELTFTYPVEIFPTRIRSTAMGFATLSSRIGAILGVVAFPVIMYSFGFKYSMLFFAVFEIIGLIVTVRYAPETKKKPLDAI

SEQ ID NO: 64 - DNA, 1374 bp, Propionibacterium acnes KPA171202
  CDS (1)..(1374): transl_table=11
atggccgccaacatcccgcttacgaacaccgccagtttgacgcccgacacgcaattggcgtcggcaccgatctcccccgaatccagacgtttcctgcgccatgtcacagccgccaccgctttcggtggcgggctcgacggcttcgacctgggcgtcattagcgtggtcatcttgcacatcaatcacgacctcgagctcacccccgctatggaggggctcgtcggtgccgcgagcctactgggcatcttcattggtgccccactcttcggcttcctcaccgataagttcggacgccgcaggatgttcctcgtcgacattattgctttcatcgttatcggcgtcgggcaggctttcgcgatgggtggagtctccctagggatcctcagattccttttagggatggccatcggagccgaatactcgatcggagcaccgatgctttcagagtttgttccggcccgggagcgtggatcgaagctggccttcctcgaactatgctggcgcatcggcttccttatcgctgtcctattggggtatgcgctgctgtggtctggagtgtcgtggaaagtcatcttggccacttcagtaatcccagccctcattgtgcttgggctgcgaatcggtcttccagaatccccgcgctggttgctgcgccacggccgtgaggccgaagcacgtgagatcgtcgaaaagcacatgggtccgaaatacttcgccgccgaacagctcagcgaggagtcggtggacggggaaggctaccgcaagctgttccgcaagggtcaacggcggcgcacgatcttcgtctgtattttctggacgtgcatcgtcaccccgtatttcgcgatcttcacctacgctccgaaagtgctggaatccctcaacgtgaagtctcaagccggcggcacgatcctctccaacaccatcggcgtcgttggcgcgatcgtcggtctgctggcgatcgatcgcatcggccgccgacgtatgctcatcggaccgttctgggggcaaaccgcagtcttgttgattgtcgggctgtggaccgacgcgccgccgtgggtgctggtggtgggcttggctcttttcgccttggtcaactcctacagcgacattcttactgcggtgtacccttctgagatcgtcgacaccgacattcgatccagtggcgtagggttcgggtcggcagtcagccgcattggtgccttccttggcacctacctgctgcccattggcatcgggacaatcggggccaagtggtgcatggtcatcgcggcaggtctatgcgtcgttggcgctgtgaccggccagacgctggcacctgagaccatgaaccggcccctgacgaaaacggcaactggagagttgtcacatgcctga

SEQ ID NO: 65 - protein, 457 aa, Propionibacterium acnes KPA171202
MAANIPLTNTASLTPDTQLASAPISPESRRFLRHVTAATAFGGGLDGFDLGVISVVILHINHDLELTPAMEGLVGAASLLGIFIGAPLFGFLTDKFGRRRMFLVDIIAFIVIGVGQAFAMGGVSLGILRFLLGMAIGAEYSIGAPMLSEFVPARERGSKLAFLELCWRIGFLIAVLLGYALLWSGVSWKVILATSVIPALIVLGLRIGLPESPRWLLRHGREAEAREIVEKHMGPKYFAAEQLSEESVDGEGYRKLFRKGQRRRTIFVCIFWTCIVTPYFAIFTYAPKVLESLNVKSQAGGTILSNTIGVVGAIVGLLAIDRIGRRRMLIGPFWGQTAVLLIVGLWTDAPPWVLVVGLALFALVNSYSDILTAVYPSEIVDTDIRSSGVGFGSAVSRIGAFLGTYLLPIGIGTIGAKWCMVIAAGLCVVGAVTGQTLAPETMNRPLTKTATGELSHA

SEQ ID NO: 66 - DNA, 1359 bp, Yersinia pseudotuberculosis IP 32953
  CDS (1)..(1359): transl_table=11
atgcaaacattaccatcggaaaaaatcaggatggacgatgtccccctaaatcgcttccatataagaattgccgggctaacttttggcgcacactttatcgatggctatatcttaggtctgattggctttgcattaattaaactcaaacccataatggcacttacaccattatgggagggattactcggatcagccgcgctgatcgggctatttctaggcagcctaatattaggctggatctcagattacattggccgccagaaaatttttagtttcagttttgtcatcattaccttagcctcagcactgcaattttttgccagtacaccagaacagttatttattttgcgggtcatcgttggtattggtatcggtggcgattactcggtgggacatactttattagctgaattttcaccacgaaaacatcgcggggtcttattgggcgcattcagtgtcatttggacctttggctatgttagtgccagtttcgttggacattatctgagtatggtcagccccgaggcttggcgttggttgttatcttctgccgccctgcccgctttacttattctcctggtacggattggtacgccggagtcaccgcgctggctaatgggaaaaggtcgtgaggacgatgccatggccattgtgcataagtactttggcccgaacgtaacgttgattgatgaggaacccgcgacttccacccgccgttttctgtctttatttggccgtaaatactggcgacgtaccgcttttaatagcttattttttgtttgtctggtgatcccctacttcgcgatctatacctttttaccctcgattcttaacgtgatggcgttgagccagaattttgctaccgacttgttattgaacggcttgctcgtggtgggtgctttagtcggtattgtcctgactgcattctgctcgcgccgtagcttcctgatctcttcctttattttcctggctacctgcctactcttgctgagcatactgccttccaatcaaacattttggctgattgcactcttcgcggcttttactcttgtgatgtctgccgtcagtaacctagtcggtgtgttcccggccgagagtttcccgaccgaagtacgctcaatgggggtgggatttgcgacttccatgagtcgcttgggatcagctattggtaccagcctgctgccattagccattgtcaattatggaatgcccgtaaccaccaccctcttggcattcgttttaattattggagccattgtttctatcgcttgggcaccggaaacgaaaggactcaccctcgttgatgcctcacaatcagcaaccacaccacgcccaccgtccagcattattccaaactga

SEQ ID NO: 67 - protein, 452 aa, Yersinia pseudotuberculosis IP 32953
MQTLPSEKIRMDDVPLNRFHIRIAGLTFGAHFIDGYILGLIGFALIKLKPIMALTPLWEGLLGSAALIGLFLGSLILGWISDYIGRQKIFSFSFVIITLASALQFFASTPEQLFILRVIVGIGIGGDYSVGHTLLAEFSPRKHRGVLLGAFSVIWTFGYVSASFVGHYLSMVSPEAWRWLLSSAALPALLILLVRIGTPESPRWLMGKGREDDAMAIVHKYFGPNVTLIDEEPATSTRRFLSLFGRKYWRRTAFNSLFFVCLVIPYFAIYTFLPSILNVMALSQNFATDLLLNGLLVVGALVGIVLTAFCSRRSFLISSFIFLATCLLLLSILPSNQTFWLIALFAAFTLVMSAVSNLVGVFPAESFPTEVRSMGVGFATSMSRLGSAIGTSLLPLAIVNYGMPVTTTLLAFVLIIGAIVSIAWAPETKGLTLVDASQSATTPRPPSSIIPN

SEQ ID NO: 68 - DNA, 1332 bp, Burkholderia sp. 383
  CDS (1)..(1332): transl_table=11
atgtcaacgaatcacatgtccatcgaggatgttccgctcaatggattccaccagttgctcacgatccgttcgggcggcggctggctcatggacggctacgtgctgagcatcatcggcgtcgcgatggtgcagttctccgacgcgcttggcctgaccggcttctggcaaggcatggtcgccgcgtccgcgctgatcggcatcttcttcggcggcttcatcggcggctggctcagcgaccgcctcgggcggaagaaaccctacttcttcggccccgtgatcttcttcgcctgctcgctcgcgcagctgtgggtccactcgggcgaagcgctgttcgtgctgcgtttcctgatcggcatcggcgtgggcatcgaatacccggtcgccggttcgctgctcgtcgagttcatgccgcgcaagtatcgcgggccgcgcctcgcgatgctgacgatcatctggttcttcggcgcggcgctcgcgtacatcgtcggcaacatcatcctcggcagcggcggccccgatgcgtggcgctgggtgctggccagcccggccgtgatcggtctcgcgctgttcgtcgtgcgcatcggcacgcccgaatcgccgcgctggctgctcagcaaggggcgcgttgccgaagccgacgacgtgatccggacagtctacggcccgtcgttctcggtgaagaacctgccggaagagcaaaccgaaaagaagatctcgctgtgggcactgctgcactcgggctacggcaagcggatgctgttcgtatcggtgttctggagctgctccgtgattcccgtgttcgccgtctactcgttcgcgccgcgcgtgctcgaggcgctgcacctgaccggcaagtgggaatcgttcggctccgtggcgatcacgttgctgttcgtggtcggctgcatcatcgcgacgtggatcatcaacgaactcggccgccgcgcgatggtgatccacagcttcctctggtcgggcctcgcgctgctgggcctcggcgcctgttcgggcggctcggccgtgctgatcctcgtgctgttcggtgcgtatgcggtgctgatcggcggcgcgcaggtcctgcagctcgtctacccgaatgaaatcttcccgaccgacattcgcgcattcgcggtcggcatgggcgcatcgctgtcacgcatcggcgcggccgtcggcacctggctcgtgccgatcgcgctgcagaccgtcggcatcggcaacaccatgtacgcagcggccgccgtctcgttcgtcgggctgatcgcatcgctcgcgctggcgcccgagacacgctcgctcagcctgcaagaggccgcgtcgctcaaccactga

SEQ ID NO: 69 - protein, 443 aa, Burkholderia sp. 383
MSTNHMSIEDVPLNGFHQLLTIRSGGGWLMDGYVLSIIGVAMVQFSDALGLTGFWQGMVAASALIGIFFGGFIGGWLSDRLGRKKPYFFGPVIFFACSLAQLWVHSGEALFVLRFLIGIGVGIEYPVAGSLLVEFMPRKYRGPRLAMLTIIWFFGAALAYIVGNIILGSGGPDAWRWVLASPAVIGLALFVVRIGTPESPRWLLSKGRVAEADDVIRTVYGPSFSVKNLPEEQTEKKISLWALLHSGYGKRMLFVSVFWSCSVIPVFAVYSFAPRVLEALHLTGKWESFGSVAITLLFVVGCIIATWIINELGRRAMVIHSFLWSGLALLGLGACSGGSAVLILVLFGAYAVLIGGAQVLQLVYPNEIFPTDIRAFAVGMGASLSRIGAAVGTWLVPIALQTVGIGNTMYAAAAVSFVGLIASLALAPETRSLSLQEAASLNH

SEQ ID NO: 70 - DNA, 1374 bp, Burkholderia sp. 383
  CDS (1)..(1374): transl_table=11
ttgactcaagccaacgttcaatccggcaccgcacgcgcgttgccgctgtcgcgtggcgccgatgcgccgcaccgccccgtcgcgctcgacgacgtgccgctcaaccgtttccacgtgaagatcgccggcctgacgttcggcgcgcatttcaccgagggctacacgctcggcacgatcggctacgcactcgccgcgctcggcaagcagatgccgatcgacgcgttctggatggggatgatcggcagctcggcgctgatcggcatcttcttcggcagtctcgtgttcggctggttgtccgaccggatgggccggcagaagatcttcctgacgagcttcgtgatcatcacggcggccgcgttcgcgcagctcttcgtcacgtcgccgctcgaactgtgcatgctgcgcgtgctgatcggcttcggaatgggcggcgacttcacggtcggccatgcgatcctcgccgaattctcgccgcgcaagcatcgcggcgcgctgctcggctcgttcagcgtgatctggacgatcggctatgtcgccgcgaacgtgctcggcctcgcgtacagcgacgccgcgcccgatgcctggcgctggctgctcgcgtcggcggcgctgcctgcgctgatcgtgctggtgctgcgaatcggcacgccagaatcgccgcgctggctgcttggcaagggccgggagaaagaagcgcgcgcgatcgtcgcgaagcatttcgggccgcacgtgatgctcgacggttcgaccgagccgcatgcgcatggcggcttctcgcggctgttccagcgtgacctgatccgccgcacggtgttcaactgtgcgttcttcgtgtgcctggtgattccgtatttcgcgatctacacgttcctgccgacgatcctgaagacgatcggcctcgccgaaggcttcggcgcggacctgctgctgaacggcttcctcgtgctgggcgcgctgatcggcatctggctgacgatccggctgtcgcggcgcggcttcctgatcggctcgttcgcggtgacgtgcgcgtcgctcgtcgcgctggcggtgctgccgtcgtcggcggccatcgcgatgatcgtcgcattcgcgatcttcacgctgacgatgtcggcgttcagcaatctcgtcggcgtgttcccgcccgagtgcttcccgaccgaagtgcgtgcaagtggcgtggggctcgcgatcgcgtgcagccggctcggttcggcgatcggcacgttcctgctgccggtcggcatcgcgacgctcggcttccacgcgacgatgttcgcgctcgcgggcgtgctgctggtggggatgatcgtgtcgatcgcgtgggcgccggagacgaagcatctgacgctggaggaggcgtcggggcattga

SEQ ID NO: 71 - protein, 457 aa, Burkholderia sp. 383
MTQANVQSGTARALPLSRGADAPHRPVALDDVPLNRFHVKIAGLTFGAHFTEGYTLGTIGYALAALGKQMPIDAFWMGMIGSSALIGIFFGSLVFGWLSDRMGRQKIFLTSFVIITAAAFAQLFVTSPLELCMLRVLIGFGMGGDFTVGHAILAEFSPRKHRGALLGSFSVIWTIGYVAANVLGLAYSDAAPDAWRWLLASAALPALIVLVLRIGTPESPRWLLGKGREKEARAIVAKHFGPHVMLDGSTEPHAHGGFSRLFQRDLIRRTVFNCAFFVCLVIPYFAIYTFLPTILKTIGLAEGFGADLLLNGFLVLGALIGIWLTIRLSRRGFLIGSFAVTCASLVALAVLPSSAAIAMIVAFAIFTLTMSAFSNLVGVFPPECFPTEVRASGVGLAIACSRLGSAIGTFLLPVGIATLGFHATMFALAGVLLVGMIVSIAWAPETKHLTLEEASGH

SEQ ID NO: 72 - DNA, 1341 bp, Rubrobacter xylanophilus DSM 9941
  CDS (1)..(1341): transl_table=11
gtggaaacccaagcagcaagaatgtcgtttgaggatataccgcgcaatagcttccactggaagatagcgatctactcggcgggcgggccgttttgtgacggttacatactgggcatcattgcgcctgctcttgcggtgctgacgccgcagctcgatctctcggcgttgatggtcagcctgatcggcgctgccacgctggtcggcatcttcatcggcgggttgctcttcggctacgtcacggacattcttggtcgtcagattatgtatgtcttggatctggcgacgtttgtcgtcgcttctgtgctccagttctttatcggcgaggggtggcagctgatcgtgctgaggctcatattgggtgtggcgattggcgccgattaccctattgccacggccctgatgacggaatttacgccgcgcaggcaccgtgggttctttctcagcttctgcgtcttcggttggtgggtgggcttcgcggcggcctacgtcgtgggatattttctcgtgggcgtgggcgaggagagttggcggtggatgctggcgagcagcgccgtgccggcagctataatcctcctgctccgtctgggcactcctgagtcccctcgttggctggccagcaagggtcgtgtccaggaggcgcttgctgtcgtgagagaagccttcggcgagaatgccgatttgggtgatctcccgcctgaaccgcctaggacctcgttctggaacatcttccgccgaggatatgccaagcggaccgtgttcgcgggcgcgttctggctgctgcaggtcacgcctctgttcgccatattcacgttcgcaccgacgatccttgaggctttcaatctcggtgggggcagagcgtcgtacctaggctccgtgatcataagcctcttcgcggttgccgggctctttcccgccatgtatcttgtcgatcgtctggggcggcgtccggtactgatatggcccttcttcataacgggtatcgctctactgatccttggtattgctcccaagagtccagcatgggtcatcataactctctttgtagtcttctccttcttcaactctggctcgagcgtgctgcagtggatctatcccaacgaactgttcccgacggaggttagagccacggccatggggttcgctactgcggtgagtcgtatcggcgctgcgatagggacgttccttctgccgctgttgctttctagcatcggcatcgggccgaccatgattatcgcggcggtgctgtgctttataggattcgtaatgagctggttcatggccccggagacaaaaggcctcaccctggatgaggccagcatggtccgtgaaccggtttcctaa

SEQ ID NO: 73 - protein, 446 aa, Rubrobacter xylanophilus DSM 9941
METQAARMSFEDIPRNSFHWKIAIYSAGGPFCDGYILGIIAPALAVLTPQLDLSALMVSLIGAATLVGIFIGGLLFGYVTDILGRQIMYVLDLATFVVASVLQFFIGEGWQLIVLRLILGVAIGADYPIATALMTEFTPRRHRGFFLSFCVFGWWVGFAAAYVVGYFLVGVGEESWRWMLASSAVPAAIILLLRLGTPESPRWLASKGRVQEALAVVREAFGENADLGDLPPEPPRTSFWNIFRRGYAKRTVFAGAFWLLQVTPLFAIFTFAPTILEAFNLGGGRASYLGSVIISLFAVAGLFPAMYLVDRLGRRPVLIWPFFITGIALLILGIAPKSPAWVIITLFVVFSFFNSGSSVLQWIYPNELFPTEVRATAMGFATAVSRIGAAIGTFLLPLLLSSIGIGPTMIIAAVLCFIGFVMSWFMAPETKGLTLDEASMVREPVS

SEQ ID NO: 74 - DNA, 1362 bp, Rhodococcus sp. RHA1
  CDS (1)..(1362): transl_table=11
atggtcaccaatccgctggacgacgcgccgctgtccaggtttcacaagaagcttgccgtgttctcgtcgggaggaccgttcctggacggattcgtcttgtccatcatcggtgtcgcgatgatccagatcgcggatcagtggggcctgtcgtccgtggagcagggactggtcggcgcatcgtcgctgatcggtattctcctcggtgcattcgccggcggttggttgaccgatcgtttcgggcgagaagtcttgttcacggtcgatttgatcgcgatcgccgcattttcggtcgcacagttcttcgtccaggacgtgatctggctgatcgtgctccgcctgctcatcggcatggcggtcggcgccgactacccgatcgccacgtcgctactgacggagttcacccctcgcaagtaccgcgggccgttcctcggcgcattcgtcgccatgtggttcgtcggcgctgcagcggcgtacgtagtgggccaggtacttgccgaaacaggaaacgacaacgcctggcgctggatgctcgccagcgccacggtgcctgcggtgctgatcgtcgtagcccgcgtcggcactcccgagtcgccgcgttggttggtgggcaagggcaggatcgacgaagccaacaaggtgctgcgtaaggtgttcggccccggcgtctccgtcgccgacctccccgcggaggacgagaacagcgtcagcgtcaaggagctcctccgttccggatacggaaagcggatggcgttcatcaccctgttctggacctgctcgatcgtccccctgtttgccgtctacgcgtttgcgcctgccattctcggcgccctcaaactggaagaggatgcggcacatatcggttccgctgtcatcacgatcctgttcctggtcggatgcatcatcgccctgttcctcgtcaaccgcatgggacgccgccccctcctcattcacagcttcctgtgggccggtctggcactgctgctgatgggagcgtttcccgaggcacctaccacgatcatcatggttctcttcgccgcatacgccgtactgatcggcggcacgcagatcctgcagtgggtctacccgaacgagctcttccccaccgagattcgtggcaccgcagtaggcatggcctcctctctgagccgcatcggtgcagcaatcggaacattcctcgtaccactgtccctcagcggcctcgggatcggagcgacgatgctcatcgcagcggtgatcacgttgctcggagcggttctgtcccacttctgggcaccggaaacccgaggactgtccttgaccgagagcgcctcgctcgggatcgccagctcaccggtatcgcccgcacgagcgtcccggtcgtaa

SEQ ID NO: 75 - protein, 453 aa, Rhodococcus sp. RHA1
MVTNPLDDAPLSRFHKKLAVFSSGGPFLDGFVLSIIGVAMIQIADQWGLSSVEQGLVGASSLIGILLGAFAGGWLTDRFGREVLFTVDLIAIAAFSVAQFFVQDVIWLIVLRLLIGMAVGADYPIATSLLTEFTPRKYRGPFLGAFVAMWFVGAAAAYVVGQVLAETGNDNAWRWMLASATVPAVLIVVARVGTPESPRWLVGKGRIDEANKVLRKVFGPGVSVADLPAEDENSVSVKELLRSGYGKRMAFITLFWTCSIVPLFAVYAFAPAILGALKLEEDAAHIGSAVITILFLVGCIIALFLVNRMGRRPLLIHSFLWAGLALLLMGAFPEAPTTIIMVLFAAYAVLIGGTQILQWVYPNELFPTEIRGTAVGMASSLSRIGAAIGTFLVPLSLSGLGIGATMLIAAVITLLGAVLSHFWAPETRGLSLTESASLGIASSPVSPARASRS

SEQ ID NO: 76 - DNA, 1410 bp, Rhodococcus sp. RHA1
  CDS (1)..(1410): transl_table=11
atgagttccttcgacgtgatggacagacccgccaaacgcgggtttcacaccaagctcctgatcgcgtgctgtggcggaccattcctggacgggtacgtcatgagcatcatcggcgtggccctgctcggggtgaccgagcaacttcacccgacgacagccgaggcagggttgatcggtgccgcctcgctgatcggaatcttcttcggcgccacagtgttcggcttcctcaccgaccggatcggccgggagaagatgtacgccctcgacctggtggtactggtcgtcgcgtgcgcattgtcggtgttcgtccaattgccgtggcagcttatcgttctgcgcttcgtcatcggtgcggccatcggtgccgactaccccatcgccacctcgctgctcaccgagttcactcccaccaagaagcgcggcgccatggtcgggatgtcggccgtcgcgtggtcggcgggcgcggttgccgcgtacgtggtcggtgcgctcgtcgtcggcatctccggtggcaacgaccattggcgcctgctcctcgcgtccagtgcggtgctgggtctgatcgtgatcctggtgcgccgcggaatcccggagtcgccgcgctggctcctgaagaacggccgggtggccgacgccgaggccgtggtcgagaagatctacggggagaaactcgacctgagcaaggtcaccgtcgaggacacggcggacaagccgaaggccgacatccggatctacttccgcggccagtacctggcccggctgatcatgtgcagcgctttgtatctggcggtcgtcaccccgctctacgcgttgctgacattcctgcccacgatcctgtcaggcttctcgatctccggtgacggttccgcggggctcatcgtcgaaaccgtcatcatcgggctcatcgtcgccggatccatccccgcactgttcctggtcgagaagtggggccggcgtccgatcgccgtggtcccgttggccctgatggtgattccgctggcagggctgtggttgtgggcggacggtcccctctggttcatcgtcgccgccttctgcgcgtacgcgttcatctccggcggtccgagcatcctggtgtggatctaccccaacgaactcttccccaccgagttccgggcgaccgcggtgggaatcgccaccgcggtgagccggttcggcgccgcgacgggcacgtacctgctgccgctgagcatctcggcgctgggaaccggcaccacgatgctcttcggtgcggtgctgacggcggtcgcgttcgtgatctgcttcttcatgtcgccggagacgaaggggaagtcgctggaagaggtgtcctccgtaaccgctgccccggtaatggggacgagcgctccccgggtggagaagttggaggaggcgtccgcgccgcgaacctga

SEQ ID NO: 77 - protein, 469 aa, Rhodococcus sp. RHA1
MSSFDVMDRPAKRGFHTKLLIACCGGPFLDGYVMSIIGVALLGVTEQLHPTTAEAGLIGAASLIGIFFGATVFGFLTDRIGREKMYALDLVVLVVACALSVFVQLPWQLIVLRFVIGAAIGADYPIATSLLTEFTPTKKRGAMVGMSAVAWSAGAVAAYVVGALVVGISGGNDHWRLLLASSAVLGLIVILVRRGIPESPRWLLKNGRVADAEAVVEKIYGEKLDLSKVTVEDTADKPKADIRIYFRGQYLARLIMCSALYLAVVTPLYALLTFLPTILSGFSISGDGSAGLIVETVIIGLIVAGSIPALFLVEKWGRRPIAVVPLALMVIPLAGLWLWADGPLWFIVAAFCAYAFISGGPSILVWIYPNELFPTEFRATAVGIATAVSRFGAATGTYLLPLSISALGTGTTMLFGAVLTAVAFVICFFMSPETKGKSLEEVSSVTAAPVMGTSAPRVEKLEEASAPRT

SEQ ID NO: 78 - DNA, 1329 bp, Pseudomonas aeruginosa UCBPP-PA14
  CDS (1)..(1329): transl_table=11
atgacaaatcctacgacctcgatcgaagacgtacccctcaacgccttccaccggctgttgaccctgcgctccggcggcggctccttcgtcgacggctacgtgctgagcatcatcggcgtggcgatgctgcagatgaccgcggcattgcaactgagcagtttctggcagggcatgatcgccgcctcggcgctggtcggcatcttcttcggcggtttcctcggcggctggctgaccgaccgcctgggccgccgcaggctgttcttcgtcggccccagcctgttcgtcctcgcttccctggcgcagtacggggtcgactcggcggcggcgctgttcgtcctgcgcttcctgatcggcgtggcggtgggcatcgagtacccggtcgccaccgccttgctggtggagttcctgccgaagaagtatcgcggaccgcgcctggccaccctgaccatcctctggttcgccggcgccgccttcgcctacctggtcggcgacctgatcctgcgcagcggcggcgaggacgcctggcgcctggtactggccagcaccgcggcgatcggcgccgtgctgttcctgctacgcatcggcacccccgagtcgccgcgctggctgctgagcaagggccgcgacgcggacgcagaacgggtcatccgccaggtctacggcgaagccttctcgctggcgaacctgcccgaacaggcgctggaacggaaggtcaccatctggcacctgctctacgccggctacggcaagcgcatgctcttcgtcaccctgttctggacctgctcggtgatccccgtgttcgccgtctacgccttcgcgcccaaggtgctgctggcgctgaacctgaagggcgactgggcctcctacggttcggtggcgatcaccctgctgttcgtcatcggctgcatcatcgccacccgcctgatcaaccgcatcggccggcgctgcatgctgctgcacagcttcctctggtccggcctggcgctgctcgggctgggcgtcttccacgccggctcggaggcgaccatcctcggcctgttcggtgcctacgcgctgttcatcggcggcgcccaggtgctgcaactggtctacccgaacgaactgttccccaccgagatccgcgccttcgcggtcggcgtcggcacctcgttgtcgcgcgtcggcgccgcggtgggcacctacctggtgccgctttccctggaaaccctgggtaccgcccagaccatgtacgccgccgcgctggtgaccctgctcgggctgctcgtgacctgggccctggcgccggaaacccgttcgctgaacctgcagcaggcggcttcgctcacctga

SEQ ID NO: 79 - protein, 442 aa, Pseudomonas aeruginosa UCBPP-PA14
MTNPTTSIEDVPLNAFHRLLTLRSGGGSFVDGYVLSIIGVAMLQMTAALQLSSFWQGMIAASALVGIFFGGFLGGWLTDRLGRRRLFFVGPSLFVLASLAQYGVDSAAALFVLRFLIGVAVGIEYPVATALLVEFLPKKYRGPRLATLTILWFAGAAFAYLVGDLILRSGGEDAWRLVLASTAAIGAVLFLLRIGTPESPRWLLSKGRDADAERVIRQVYGEAFSLANLPEQALERKVTIWHLLYAGYGKRMLFVTLFWTCSVIPVFAVYAFAPKVLLALNLKGDWASYGSVAITLLFVIGCIIATRLINRIGRRCMLLHSFLWSGLALLGLGVFHAGSEATILGLFGAYALFIGGAQVLQLVYPNELFPTEIRAFAVGVGTSLSRVGAAVGTYLVPLSLETLGTAQTMYAAALVTLLGLLVTWALAPETRSLNLQQAASLT

SEQ ID NO: 80 - DNA, 1398 bp, Mycobacterium smegmatis str. MC2 155
  CDS (1)..(1398): transl_table=11
gtgtccgcacaccagccacacaccgtgtccagcccccgccatgtacccatagacgaccgaccactcaccgcgttccacaagcggctcaccgtgttctcggcgggcgggccgttcctggacggcttcgccctcacgatcatcggcatcgcgctgatcagcatggtgcccgcgctggacatgagcaccgtcgacgtgggtctggtgggcgcctcggcgctgatcgggatcttcgtcggcggtctggtgttcggctatgtcaccgatcgggtcggccgcaaagtcatgtacatcgccgacctcaccatgctcgtcgtggtgtcgatcgcatcggcgttcgcgaccgaggtgtggcaactggtcgcgctgcgtttcctgctcggcgtggcgatcggcgccgactaccccatcgccagttcgctgctcgcggagttcatcccgagccgctaccgtggccggctgctgggcgcactgttcgtcgtgtgggccggaggtgccgccgctgccgccggcgtgggctgggcgctgtcgacgatgggcccggacgcctggcggtggatgctggcaagtcccgcggtgttcggtgtcgtcaccctgatgctgcgggccggaactcccgaatcgcccaggtggcttttgagccgggggcgcaccgaggaggcgcagcgcgtgtgccgcaaggtgtggggcaacgacgccgacatcgccatgatcccggccgaacccgcgcataccccgttcaccgcgctgttccgggggatctacttgcgcagggtggtcttcgtcggggtgttcttcaccgcccacgtgatcccgctgttcgcggtgtacacgttcggcccggacatcctgcgggagatgggtgtcggtgcacacggctcccaccacgtgtacgtcgcggaacttgtgatcagcctgctgttcctggtcggcggggtccccgggctgctcctcgtggacaggatcggccgaaagcccctgctgctgtggacctttgccgtgatgagcgcggcgttcatcgcgatggccgtggtgccgggtgcgcccgcgcagatcctgttcgcactgcttgcgctctatgccgtcacgtccggagcctgcaatttcatcgagatcatctaccccaacgagcttttccccacgtcggtgcgtgcgagtgccacggggaccgtcgtcgcgatcagccgcgtcggttcggcggtcagcaccttcgtgttgccgctcgtgctcagcggcaccggactcggcggggtgatgtggctgctcgcgggggtcaacgtcgtcggcctgctggtcacgctcgtgctcggcgaggaaacgcgcggtcgcgcgctgtcggagacctcggccgccacgcgtctcaccgaaccggaaacccggtcggatcccgtggacgcgtga

SEQ ID NO: 81 - protein, 465 aa, Mycobacterium smegmatis str. MC2 155
MSAHQPHTVSSPRHVPIDDRPLTAFHKRLTVFSAGGPFLDGFALTIIGIALISMVPALDMSTVDVGLVGASALIGIFVGGLVFGYVTDRVGRKVMYIADLTMLVVVSIASAFATEVWQLVALRFLLGVAIGADYPIASSLLAEFIPSRYRGRLLGALFVVWAGGAAAAAGVGWALSTMGPDAWRWMLASPAVFGVVTLMLRAGTPESPRWLLSRGRTEEAQRVCRKVWGNDADIAMIPAEPAHTPFTALFRGIYLRRVVFVGVFFTAHVIPLFAVYTFGPDILREMGVGAHGSHHVYVAELVISLLFLVGGVPGLLLVDRIGRKPLLLWTFAVMSAAFIAMAVVPGAPAQILFALLALYAVTSGACNFIEIIYPNELFPTSVRASATGTVVAISRVGSAVSTFVLPLVLSGTGLGGVMWLLAGVNVVGLLVTLVLGEETRGRALSETSAATRLTEPETRSDPVDA

SEQ ID NO: 82 - DNA, 1398 bp, Mycobacterium smegmatis str. MC2 155
  CDS (1)..(1398): transl_table=11
atgaacccactcgatgtaatggaccgccccgccaagggcggcttccacacccgcatcctggttgcctgctgcggcggcccgttcctcgacggctacgtcatgagcatcatcggcgtggcactgctcggagtctccgaacaactgaaccccaccaccgccgaaagcggcctgataggggcagcgtcgttgatcggtatcttcttcggggccactctgttcggtttcctcaccgaccgcatcggccgcgagaaaatgtacgccctcgacctcgtggtcctcgtcgtcgcgtgcgcgctctccgttttcgtcaccgccccatggcaactcatcgtcctacggttggtcataggcgcggccatcggcgccgactatcccatcgccacctcgctgctgaccgagttcacccccacccgcaaacgcggagccatggtgggaatgtcggcggtggcctggtcggccggcgccgtcagcgcctacatcgtcggagccatcgtcgtcgccgcgtccggaggcaacgacaattggcgctggcttctggccaccagcgccatcctcggtgtgatcgtcatcctggcacgtcgcggcatcccggaatccccccgctggctgctacgtcaggggcggatctccgacgctgaagacgtcgtcgaacggatctacggcgtgcgtcccacgctcagcgcaatcaccgacgaaccccacgtcgagtccccgaaaagggaactcacgcagtttctccgcggcgagtacctcaaacgcatcgtcatgtgctcaatgctgtacctggctgttgtcaccccgttgtacgccctgctcacatacctgccgacgatcctcaccggcttccacatccaaggcgacggccccagcggactccttgtggaaaccgtcatcatcgggctcaccgtcgccggctccatcctgtcgctgtaccttgtcgaacactggggccggcgcccactcgccgtcgtcccgctcggtctgatggtgcttcccttggtgggcctgtggctgtggggagatgcgcccctgtggtttgtcgtcgcggcgttctgtgcatactccttcatctccggcggtcccagcatcctggtgtggatctacccgaacgagttgtttcccaccgaattccgagcgaccgccgtcggactcaccaccggcatcagccgattcggcgcagcgaccggaacctacctgctgcccttgagcatctccaccctcggcgtcggcatcaccatgctgttcggagccatcctcaccgcagcagcattcgcgacatgcgcactgctcgccaccgaaaccaaagaccgcagcctcgaggaagcctccgcgatcgaggcctcccccaccacgcccagccgatccgaacggacgcccgacaagagatcggtcgtgtga

SEQ ID NO: 83 - protein, 465 aa, Mycobacterium smegmatis str. MC2 155
MNPLDVMDRPAKGGFHTRILVACCGGPFLDGYVMSIIGVALLGVSEQLNPTTAESGLIGAASLIGIFFGATLFGFLTDRIGREKMYALDLVVLVVACALSVFVTAPWQLIVLRLVIGAAIGADYPIATSLLTEFTPTRKRGAMVGMSAVAWSAGAVSAYIVGAIVVAASGGNDNWRWLLATSAILGVIVILARRGIPESPRWLLRQGRISDAEDVVERIYGVRPTLSAITDEPHVESPKRELTQFLRGEYLKRIVMCSMLYLAVVTPLYALLTYLPTILTGFHIQGDGPSGLLVETVIIGLTVAGSILSLYLVEHWGRRPLAVVPLGLMVLPLVGLWLWGDAPLWFVVAAFCAYSFISGGPSILVWIYPNELFPTEFRATAVGLTTGISRFGAATGTYLLPLSISTLGVGITMLFGAILTAAAFATCALLATETKDRSLEEASAIEASPTTPSRSERTPDKRSVV

SEQ ID NO: 84 - DNA, 1338 bp, Escherichia coli
  CDS (1)..(1338): transl_table=11
atgaacacttcaccggtgcgaatggatgatttaccgcttaaccgttttcactgccgcattgctgcgctcactttcggcgcacacctgaccgacggttatgttctcggcgtcattggttacgccattattcagcttacgcccgccatgcaactgacgccgtttatggcgggaatgatcggcggctcggcgctccttggtttgttccttggcagcctggttcttgggtggatctccgaccatattggtcggcaaaaaatcttcaccttcagctttttgctgattacgcttgcttcgtttttacaattttttgccaccacgccagagcatcttattggactgcgcattttgattggcattggtctgggaggcgattattcagtaggtcacaccttgctggctgaattttccccgcgccgccatcgcggtattttgctgggcgcattcagcgtggtgtggaccgtaggctatgtgctggcaagtattgccggacatcactttatttccgaaaacccggaggcctggcgctggctactggcatcggcagctctgcccgcgttgttgattacgttattacgctggggaacgccagaatcaccacgctggctactgcgccaggggcgttttgcagaagctcacgctatcgtgcatcgctattttggtccccatgttttactgggcgatgaagtggtaacggcgacccataaacacatcaaaaccttgttctcttcgcgttactggcggcgcacggcgtttaacagcgtcttctttgtctgcctcgtaatcccatggtttgtgatttatacctggctgccaactatcgcccagactattggtctggaagatgcgctgactgccagcctgatgcttaatgcgttgttaattgtgggcgcgctgctgggattagttctgacgcacctgctggcacatcgcaaatttttgctgggaagttttttgctgctggcggcaacgctggtagtcatggcctgtttgccttccggcagttcattaacgctgctgctttttgttctcttcagcaccaccatttcggcagtcagtaatctggtgggcattttgcctgcggaaagttttcctactgacattcgctcgctgggcgtcggttttgccactgccatgagtcgacttggcgcggcggtaagtactggcctgctgccgtgggtgctggcgcagtggggaatgcaagtcaccttattgctcctggcgacagtgttgttggttggttttgttgtgacctggctatgggcaccagaaactaaagccctcccgctggtggcggcgggaaatgtaggaggtgcgaatgaacattctgttagcgtttaa

SEQ ID NO: 85 - protein, 445 aa, Escherichia coli
MNTSPVRMDDLPLNRFHCRIAALTFGAHLTDGYVLGVIGYAIIQLTPAMQLTPFMAGMIGGSALLGLFLGSLVLGWISDHIGRQKIFTFSFLLITLASFLQFFATTPEHLIGLRILIGIGLGGDYSVGHTLLAEFSPRRHRGILLGAFSVVWTVGYVLASIAGHHFISENPEAWRWLLASAALPALLITLLRWGTPESPRWLLRQGRFAEAHAIVHRYFGPHVLLGDEVVTATHKHIKTLFSSRYWRRTAFNSVFFVCLVIPWFVIYTWLPTIAQTIGLEDALTASLMLNALLIVGALLGLVLTHLLAHRKFLLGSFLLLAATLVVMACLPSGSSLTLLLFVLFSTTISAVSNLVGILPAESFPTDIRSLGVGFATAMSRLGAAVSTGLLPWVLAQWGMQVTLLLLATVLLVGFVVTWLWAPETKALPLVAAGNVGGANEHSVSV

SEQ ID NO: 86 - DNA, 1620 bp, Arabidopsis thaliana
  CDS (1)..(1620)
atgacaggtgccacaccggaaaaccgaacggccccgtcgccaccaccggtgaaacatgtgccggagtcagttctgccggctaaaccaccaaagaggaacaattatgcattcgcgtgtgctatcttagcttccatgacttctatcctccttggttatgatataggagtgatgagtggagcaatgatttatataaagagagatttgaagattaatgatttacaaatcgggattctcgctggaagcctcaacatctattcacttataggatcttgcgccgccggaagaacctctgactggattggtcggcgttacactatcgtgttggctggagccatattcttcgccggagctatccttatgggattgtcccctaactacgctttcctcatgttcggaaggttcatcgccggtatcggcgtcggatatgctctcatgatcgcaccagtttataccgccgaagtctctccggcatcttcccgcggcttcctcaattccttccccgaggtgtttatcaacgccggaattatgctcgggtacgtatcaaatctggctttctcgaacttgccgttgaaggtaggatggagactgatgctcggaatcggagccgtaccttccgtgatactcgctatcggcgttctcgctatgccggaatctccacggtggctcgttatgcaaggccgtctcggtgatgccaagcgcgttctggacaaaacctctgattcccccaccgaagcaactctccgtctcgaagacatcaaacacgccgctggtattcccgccgattgccacgacgacgtcgttcaggtgtcgaggaggaacagtcatggagaaggagtttggagagagcttttaatccgaccaacaccagccgtgcgtcgtgttatgatcgccgcaatcggaatccatttcttccagcaagcttccggtatcgacgcggtggttctcttctcaccgcgaattttcaaaaccgccggactcaaaaccgatcaccaacagcttctagcgactgtagcagtaggagtagtgaagacatcattcatactagtcgccactttcttactcgacagaatcgggagaagaccattgcttctaaccagcgtaggaggaatggtactatctctagcagcgttagggacttctctaacgattatagaccagtcagagaagaaagtgatgtgggctgtggttgtagctatagctacggtgatgacttatgtagctacgttttcgataggagctggaccgataacttgggtttatagctcggagatattcccgttgaggttgagatcacagggctcgagtatgggtgtggtggtgaacagagtgactagtggtgtgatctcgatatcgtttcttccaatgtcgaaagcgatgactactggtggagcgttttacttgtttggagggattgcgactgtggcttgggttttcttttacactttcttgccggagacgcaagggaggatgcttgaggatatggatgagcttttcagtggtttcaggtggagagattccaagagtaagcctaagggtaaccccgagaagacggtaccgaatcccgaggttgagattggatcaaacaagcagtggaaggaaggagacacacaaagttcgtag

SEQ ID NO: 87 - protein, 539 aa, Arabidopsis thaliana
MTGATPENRTAPSPPPVKHVPESVLPAKPPKRNNYAFACAILASMTSILLGYDIGVMSGAMIYIKRDLKINDLQIGILAGSLNIYSLIGSCAAGRTSDWIGRRYTIVLAGAIFFAGAILMGLSPNYAFLMFGRFIAGIGVGYALMIAPVYTAEVSPASSRGFLNSFPEVFINAGIMLGYVSNLAFSNLPLKVGWRLMLGIGAVPSVILAIGVLAMPESPRWLVMQGRLGDAKRVLDKTSDSPTEATLRLEDIKHAAGIPADCHDDVVQVSRRNSHGEGVWRELLIRPTPAVRRVMIAAIGIHFFQQASGIDAVVLFSPRIFKTAGLKTDHQQLLATVAVGVVKTSFILVATFLLDRIGRRPLLLTSVGGMVLSLAALGTSLTIIDQSEKKVMWAVVVAIATVMTYVATFSIGAGPITWVYSSEIFPLRLRSQGSSMGVVVNRVTSGVISISFLPMSKAMTTGGAFYLFGGIATVAWVFFYTFLPETQGRMLEDMDELFSGFRWRDSKSKPKGNPEKTVPNPEVEIGSNKQWKEGDTQSS

SEQ ID NO: 88 - DNA, 1641 bp, Arabidopsis thaliana
  CDS (1)..(1641)
atgcagtcgtcaacgtatgcggttaaaggaaacgctgcgtttgcgtttcagagacggaccttctcttctgacagatcgacgacttctaccggaattcgcttcgctggttataagagcttagccaccaccgggccactctactgttctggttctgaagccatgggagcgacgcttgctcgtgctgataacgggatccagagcgttatgagtttctcttctgtcaaagctcgatcggtcagagctcaagcctcatctgatggagatgaagaagaagctatacctctgagatctgaagggaaaagctctggaacagttttgccttttgttggtgttgcttgtcttggtgctatactctttggttatcatctcggggtggttaatggtgctcttgaatatcttgctaaggatcttgggatcgccgaaaatactgttttgcaaggatggattgttagttctctgcttgctggtgctacggtaggttcattcactggaggtgcattagctgacaaatttggacgaacaagaacttttcaattggatgctatcccgcttgccattggagctttcttatgtgcaacagctcagagtgtgcagactatgattgtgggacgtctgctcgctggaattggaattggaatctcatcagcgattgtaccactttacatatctgagatatcaccaactgaaatccgtggagcactcggatctgtgaaccagttgttcatctgtataggaatacttgcagccttgatagctggattaccccttgcagcaaaccctctatggtggaggacgatgtttggtgttgcagttatcccttccgttctattggccataggaatggctttttctccagaaagcccaaggtggctcgttcagcaaggaaaagtctctgaagctgaaaaggcgatcaaaactttgtatggtaaagaaagagtggttgaactagttcgcgacttatcagcctctggccaaggttcttctgagccggaggcaggatggtttgatctattcagcagccgctactggaaagttgtaagcgtaggtgcggctctcttcttgtttcaacagttagccgggataaacgcagttgtgtattactccacatcggtattccgtagtgcgggaatccaatcagatgttgcagccagtgctctcgttggagcatcaaatgtctttggcactgctgttgcttcatcgttgatggataaaatgggaaggaaaagtcttttactgacaagctttggtggaatggctttgtcaatgctgttactctccttgtccttcacatggaaggctcttgctgcctattctggaacccttgccgttgttggaactgttctatatgtcctgtcattctcacttggtgctggcccggtaccggctcttcttcttccagagatatttgcatcccgaatcagagcaaaagccgtcgctctttctctcggcatgcactggatatcaaactttgtgatcggactatacttcttaagcgttgtgactaaattcggaatcagcagtgtctacttgggttttgctggagtctgcgtccttgcggtcctctacattgcaggaaacgtcgtcgagactaaaggtcgatcactggaggaaatagagcttgctcttacatctggagcttga

SEQ ID NO: 89 - protein, 546 aa, Arabidopsis thaliana
MQSSTYAVKGNAAFAFQRRTFSSDRSTTSTGIRFAGYKSLATTGPLYCSGSEAMGATLARADNGIQSVMSFSSVKARSVRAQASSDGDEEEAIPLRSEGKSSGTVLPFVGVACLGAILFGYHLGVVNGALEYLAKDLGIAENTVLQGWIVSSLLAGATVGSFTGGALADKFGRTRTFQLDAIPLAIGAFLCATAQSVQTMIVGRLLAGIGIGISSAIVPLYISEISPTEIRGALGSVNQLFICIGILAALIAGLPLAANPLWWRTMFGVAVIPSVLLAIGMAFSPESPRWLVQQGKVSEAEKAIKTLYGKERVVELVRDLSASGQGSSEPEAGWFDLFSSRYWKVVSVGAALFLFQQLAGINAVVYYSTSVFRSAGIQSDVAASALVGASNVFGTAVASSLMDKMGRKSLLLTSFGGMALSMLLLSLSFTWKALAAYSGTLAVVGTVLYVLSFSLGAGPVPALLLPEIFASRIRAKAVALSLGMHWISNFVIGLYFLSVVTKFGISSVYLGFAGVCVLAVLYIAGNVVETKGRSLEEIELALTSGA

SEQ ID NO: 90 - DNA, 1551 bp, Arabidopsis thaliana
  CDS (1)..(1551)
atggctaacgaagaacaaggaagcatcttgaaagctcttgacgttgcaaagactcaatggtaccacgtcacggcggttgtagtctccggtatgggtttcttcacagactcatacgatctcttcgtgatatctcttatcacgaagcttcttggccggatctactatcaggttcctggctcctcctctcccggaagcctccctgacggcatctctgcggccgtgagtggtgtggccttcgctggaacgtttatcggacagattttctttgggtgtcttggtgacaagcttggacgtaagagagtctatggtttgactctcttgatcatgaccatatgctccatttgttctggtctttcccttggaagagacccgaaaaccgtcatggtaactctctgcttcttccgcttctggctcgggtttggcatcggtggtgactatcctctctcggctacgatcatgtccgagtattccaacaaacgtactcgcggtgctttcatagcagctgttttcggtatgcaagggattgggatccttgccgcaggagctgtctcgttacttgtctcagctgttttcgagagtaagtttccgtcccgagcctatatattggatggtgcagcctccaccgtcccacaggcggattacgtttggaggatcatcctgatggtcggcgccttaccagctctcttgacctactactggcggatgaagatgcccgaaaccgctcgttacacggctcttgtctccaagaacgcggagcaagcggctttagatatgactaaggttctcaacgtagacattgaagcctctgccgcaaagaatgatcaagctagggtttcctcggacgagtttggcttgttctccatgaagttccttcgccgtcacggactccacttactcggaacagcctccacatggttcctcctcgacatcgctttctacagccaaaacttgttccagaaggatatcttcaccaccattgggtggttaccttcggctaaaaccatgaacgcaatccaagagctctacatgatcgctaaggctcaaaccataatcgcttgttgcagcaccgttcccggttactttttcactgtagggttcatcgattatatgggacggaaaaagatccagatcatgggtttcgctatgatgaccatcttcatgctcagtttagccataccgtaccatcattggaccttaccggctaaccggattggtttcgtcgttctttactctttcacatttttcttctccaattttggacctaacgcaactactttcattgtcccggctgagattttcccggcgaggataaggtcgacttgtcacggtatatcggcggcgtctggtaaagccggtgcgatggtcggttctttcgggttttcggctttggttaaagctttgggtatgagtaacacgttatacatcatggcaggaatcaatttgcttggcttgcttctcacgtttacaattccggagactaatgggaaatcacttgaggagctttccggcgaaactgagccggagaaaatcaaggagaagattgttgtttag

SEQ ID NO: 91 - protein, 516 aa, Arabidopsis thaliana
MANEEQGSILKALDVAKTQWYHVTAVVVSGMGFFTDSYDLFVISLITKLLGRIYYQVPGSSSPGSLPDGISAAVSGVAFAGTFIGQIFFGCLGDKLGRKRVYGLTLLIMTICSICSGLSLGRDPKTVMVTLCFFRFWLGFGIGGDYPLSATIMSEYSNKRTRGAFIAAVFGMQGIGILAAGAVSLLVSAVFESKFPSRAYILDGAASTVPQADYVWRIILMVGALPALLTYYWRMKMPETARYTALVSKNAEQAALDMTKVLNVDIEASAAKNDQARVSSDEFGLFSMKFLRRHGLHLLGTASTWFLLDIAFYSQNLFQKDIFTTIGWLPSAKTMNAIQELYMIAKAQTIIACCSTVPGYFFTVGFIDYMGRKKIQIMGFAMMTIFMLSLAIPYHHWTLPANRIGFVVLYSFTFFFSNFGPNATTFIVPAEIFPARIRSTCHGISAASGKAGAMVGSFGFSALVKALGMSNTLYIMAGINLLGLLLTFTIPETNGKSLEELSGETEPEKIKEKIVV

SEQ ID NO: 92 - DNA, 1653 bp, Oryza sativa
  CDS (1)..(1653)
atgattcgttgcgttgtaaagtgcggcgggcagcagcagcacgtcgtcgtcgctgcgcgcggtgatcggaagtcgccggcgatcgcggcgccaccaccagcgaccgtgcggatgccgggccgcgtgctctgctgcggcatgaggtcgcgcggggcggatctcgccggcgtcgagatggcggcggggccgcagccgcagggcggcgtctcggggctcttccgcggcccgcgctcgagcccgcgctactcccgcgtgcgcgccaccgccacagttgatcctgaggatattccattggagaaggttcaagctaaatcttctggaagtgttctgccatatgtgggcgttgcttgtttgggggctattttatttggttatcatcttggagtggtcaacggcgctcttgaatatcttgcaaaggaccttggaatttctgagaatgctgtgttacaaggatgggtggttagcacaaccctggctggtgcgacagcaggttcttttactggaggtgctttagctgacaaatttggacgaacacggacgttcatcctggatgcaatccctctcgctgtaggtgcattcctgagtgcaacagctcatgatgttcgcacaatgattattggccgattacttgctgggattggtattggcatatcttctgctcttgtgcccctttacatatctgagatttcacccactgaaatacgtggagcacttggttctgttaatcagctttttatctgcattggaattcttgctgctctggtagctggattacctctggcaggaaaccctgcttggtggaggacaatgttcggaatttcaattgttccatccattttgcttgctcttgggatggctgtttcacctgaaagccctcgttggctattccagcaaggaaaactttctcaggcagaaacagctattaaaaaactatatggaagagaaaaagttgctgaagttatgtatgacctaaaagctgccagccaaggttcttctgagccagatgctggctggttggatcttttcagcaaacgctattggaaagttgttagtgtgggcgcagctatgttcttgttccaacagcttgccggtataaatgctgttgtatattactctacatcggtgttccgcagtgcaggcattgcatctgatgttgcagcgagtgcccttgttggagcagccaatgtttttggtacaatgattgcatcttctctgatggacaagcaaggaaggaagagccttctgataacaagcttttctggcatggctgcctcaatgttacttctatcattgtccttcacgtggaaggctttggcaccttattcaggccctcttgctgttgctggcactgttttgtatgtgctgtcttttgctcttggagctggcccagttccagcattgctccttcctgaaatatttgcctccagaataagggctaaagctgttgcattatctctgggcatgcactgggtttcgaacttctttattggcctctacttcttgagcgtcgtcaacaaattcggaatcagcactgtgtatttgggatttgcatctgtttgcgctcttgctgttgtctacatagctggaaatgtggttgagaccaaggggcgttctctggaagagattgagcgggctctaagttcagcaagctga

SEQ ID NO: 93 - protein, 550 aa, Oryza sativa
MIRCVVKCGGQQQHVVVAARGDRKSPAIAAPPPATVRMPGRVLCCGMRSRGADLAGVEMAAGPQPQGGVSGLFRGPRSSPRYSRVRATATVDPEDIPLEKVQAKSSGSVLPYVGVACLGAILFGYHLGVVNGALEYLAKDLGISENAVLQGWVVSTTLAGATAGSFTGGALADKFGRTRTFILDAIPLAVGAFLSATAHDVRTMIIGRLLAGIGIGISSALVPLYISEISPTEIRGALGSVNQLFICIGILAALVAGLPLAGNPAWWRTMFGISIVPSILLALGMAVSPESPRWLFQQGKLSQAETAIKKLYGREKVAEVMYDLKAASQGSSEPDAGWLDLFSKRYWKVVSVGAAMFLFQQLAGINAVVYYSTSVFRSAGIASDVAASALVGAANVFGTMIASSLMDKQGRKSLLITSFSGMAASMLLLSLSFTWKALAPYSGPLAVAGTVLYVLSFALGAGPVPALLLPEIFASRIRAKAVALSLGMHWVSNFFIGLYFLSVVNKFGISTVYLGFASVCALAVVYIAGNVVETKGRSLEEIERALSSAS

SEQ ID NO: 94 - DNA, 1647 bp, Oryza sativa
  CDS (1)..(1647)
atggttcaggatcgcaaggtgctcgacgcgctggacacggcgaagacgcagtggtaccacttcacggcggtggtgatcgccggcatgggcttcttcaccgacgcctacgacctcttctccatctccctcgtcaccaagctgctcggccgcatctactacttcaacccggcgtccaagagccccggctccctcccgcccaacgtctccgccgccgtcaatggcgtcgccttctgcggcacgctcgccggccagctcttcttcggctggctcggcgacaagatggggcgcaagaaggtgtacgggatgacgctcatgctcatggtcatctgctgcctcgcctccggcctctcgttcgggtcgtcggcgaaaggcgtcatggccacgctctgcttcttccgcttctggcttgggttcggcatcggtggcgactacccgctctcggcgaccatcatgtcggagtatgctaacaagcgtacccgtggcgcgttcatcgccgccgtgttcgccatgcagggcttcggcaacctcaccggcggcatcgtggccatcatcgtgtccgccgcgttcaagttgcggttcgacgcgccggcgtacagggacgaccgggccggctccaccgtgccgcaggctgactacgcgtggcgcatcgtgctcatgttcggcgccatcccggcgctgctcacctactactggcggatgaagatgccggagacggcgcgctacaccgcgctggtcgccaagaacgacaagaaggcagccgccgacatggcgcgcgttctcaacgtcgagctcgtcgacgagcaggagaaggcagcggcggcgacggcggcggctgcggaggaggaggcagcacggcgcgagcagtacgggctcttctcccgggaattcgcacggcgccatggccaccacctgctgggcacgacggtgtgctggttcgtgctggacatcgcctactactcgcagaacctgttccagaaggacatctacacggcggtgcagtggctgcccaaggcggacaccatgagcgccctggaggagatgttcaagatctcccgggcacagacgctcgtggcgctgtgcggcaccatcccgggctactggttcaccgtcctcttcatcgacatcgtcggccgcttcgccatccagctcggcggcttcttcctcatgacggcgttcatgctcggcctcgccgtgccgtaccaccactggacgacgccggggaaccacgtcggcttcgtggtcatgtacgccttcaccttcttcttcgccaacttcgggccaaactccacgaccttcatcgtgccggccgagatcttcccggcgaggctgcgttccacctgccacggcatctcgtcggcggccgggaagatgggcgccatcgtcgggtcgttcgggttcttgtacgccgcgcagagcaccgacccgagcaagacggacgccggctacccgcggggcatcggcgtgcgcaactcgctgttcctgctcgccggatgcaacgtcgtcggcttcttgttcacgttcttggtgccagagtcgaaggggaagtcgctggaggagctctccggcgagaacgaaatggaggctgagccggcggcagcaactaactcctacaggcagaccgtccctgacagcggacagtccgagtaa

SEQ ID NO: 95 - protein, 548 aa, Oryza sativa
MVQDRKVLDALDTAKTQWYHFTAVVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKLRFDAPAYRDDRAGSTVPQADYAWRIVLMFGAIPALLTYYWRMKMPETARYTALVAKNDKKAAADMARVLNVELVDEQEKAAAATAAAAEEEAARREQYGLFSREFARRHGHHLLGTTVCWFVLDIAYYSQNLFQKDIYTAVQWLPKADTMSALEEMFKISRAQTLVALCGTIPGYWFTVLFIDIVGRFAIQLGGFFLMTAFMLGLAVPYHHWTTPGNHVGFVVMYAFTFFFANFGPNSTTFIVPAEIFPARLRSTCHGISSAAGKMGAIVGSFGFLYAAQSTDPSKTDAGYPRGIGVRNSLFLLAGCNVVGFLFTFLVPESKGKSLEELSGENEMEAEPAAATNSYRQTVPDSGQSE

SEQ ID NO: 96 - DNA, 1659 bp, Oryza sativa
  CDS (1)..(1659)
atggctccgatcggcgtgctcacggcgctggaccaggcgcggacgcagtactaccacttcaaggccatcgtcatcgccggcatgggactcttcaccgactcctacgacctcttctgcatcgcgcccgtcatgaagatcgtgggccgggtgtactactccgacggcggcgcccgtccgggggtgacgccgccggccgtcgtgtcggcgaccgtcggagtggcgctgctgggcgcggtgatcgggaacgtggtgttcggcgcgctgggcgaccgcgtggggcggcgccgcgtctacggcgcgtgcctgctgctgatggtgtgcagctccgtcgggagcggcttctccgtgtgccggacgcgccggtgcgcgctcgccagcctctgcttcttccgcttcctcctcggcgtcggcgtcggcggcgactacccgctgtcggccaccatcatgtcggagttcgccaaccggcgcacccgcggcgcgttcatcgccgccgtgttctccatgcaggggttcggcatcctcgccagctccgcggtcaccatggccgtcgccgccgccttcgaccactacaccggctaccccgcgccgctcgacacgccggagtgcgccgacctcgcctggcggatcattctcatggccggcgccgtccccgccgcgctgacgtactactggaggatgtccatgccggagacggccagatatacggctttggtggagcgcgacgtggtgaaggccaccaacgacatcggccgcgttctggccgacctcgacctgggcgccgtcgccgaggaggaggtggcggcggcgttgagccggcctccgccgccgccgcgcccttcgtacggcctcctctctcggcgcttcgtccggcagcacgggcgggacctgttcgcgtgcgcggcggcgtggttcctcctcgacatcccctactacagcagcacgctgttccagtctcagatctaccggccgctgttcccggcgccggggctcatcaacgcgttccaggaggcgttcaacgtggccaagttccaggccgtcatcgccgtcgcctccaccatcccgggctacttcgtcgccgtgctcctcatcgaccgcgtcggccggcggtgcctccagatggccgggttcctcctcatggccgtcttcctcttcgcgctcgcgggtccgtacgacggatactggcgcgaccacggcgcgcacgccggctacatcgtgctctactcgctcaccttcttctccgccaacctcgggccgaacaccaccaccttcatcctgccggcggagctcttcccggcgcgcttccggtcgacgtgccacggcctctccggcgcggcggggaagctcggcgcgctcgtcggctccatcggcttcctgtgggcgtcgcagcagaaggacggcgcggcggccgggcacctgccgggcatcggcatgatgtacgcgctgttcgttcttggcgggatctgcctgctcgggctggcactcacctacgtgttcacgccggagacgatgatgcggtcgctggaggagaacgagagcgacagggcgcagacccaggtcggcgacggcggcagcgacaccgaggcggccaagagcccggcgtccatggcgagctcgcacctcagcatgtcgcccatccttccagcccgggtctccgtgtga

SEQ ID NO: 97 - protein, 552 aa, Oryza sativa
MAPIGVLTALDQARTQYYHFKAIVIAGMGLFTDSYDLFCIAPVMKIVGRVYYSDGGARPGVTPPAVVSATVGVALLGAVIGNVVFGALGDRVGRRRVYGACLLLMVCSSVGSGFSVCRTRRCALASLCFFRFLLGVGVGGDYPLSATIMSEFANRRTRGAFIAAVFSMQGFGILASSAVTMAVAAAFDHYTGYPAPLDTPECADLAWRIILMAGAVPAALTYYWRMSMPETARYTALVERDVVKATNDIGRVLADLDLGAVAEEEVAAALSRPPPPPRPSYGLLSRRFVRQHGRDLFACAAAWFLLDIPYYSSTLFQSQIYRPLFPAPGLINAFQEAFNVAKFQAVIAVASTIPGYFVAVLLIDRVGRRCLQMAGFLLMAVFLFALAGPYDGYWRDHGAHAGYIVLYSLTFFSANLGPNTTTFILPAELFPARFRSTCHGLSGAAGKLGALVGSIGFLWASQQKDGAAAGHLPGIGMMYALFVLGGICLLGLALTYVFTPETMMRSLEENESDRAQTQVGDGGSDTEAAKSPASMASSHLSMSPILPARVSV

SEQ ID NO: 98 - DNA, 1527 bp, Brassica napus
  CDS (1)..(1527)
atggccgttgttgtatctgctaacgggaatggtccggcttttgaagccaagatgactgtatatgtctttgtctgcgttctgattgcagctgtcggcggtttgatcttcggttacgacatcggaatttccggtggagtgacggcgatggatgatttcttgaagaagtttttccctacggtgtgggagaggaagcagcacgctcatgagaacaattactgcaagtatgataaccagcacttgcagctattcacatcgtctctttacctagccgcactcgtggccagcttcttggcttcggccgtctgttccaaacttggaaggaagcccactatgcagtttgcttctgtctttttcttgatcggtgtcgggctagccgcaggagctgataacatcgtcatgttgatcattggaagaatcttacttggcttcggtgtaggctttggcaatcaggcagtgccgcttttcttatccgagattgctcctgcacagctcaggggaggtctcaatattgtattccaactcatggtcacaattggaatactaatagccaaccttgtcaactacttcactgccaccgttcaccctaacggatggcgaatcgccctcggtggagccgcaatccccgcggttatcctcctcttgggttcactgatcatctgtgagacccccacgagcctcatagagcgcaacaaaaacgaagaaggcagagaaactctaaggaaaatcagaggagttgaagatataaatgatgagtatgaatctatcgtccatgcgtgcgagattgcgagtcaagttaaagacccttacaggaaactgttgaaaccagcgagtcgtccacctttaatcattggaatgcttctacagcttttccagcagtttagtggaatcaatgctattatgttctatgcaccagttttgttccagactgttggatttggaaataacgcagctcttctctctgcggttatcacgggaagcatcaacgttcttagtacgttcgtagggatctacctcgtggacagaaccggtcggaggttccttcttttacaatcttccgttcacatgctcatttcccagttgatcattggaatcatcctagcgaaagacttgggcatcacgggaacactcgggaaggcacaagccatggtggttgtggtctttgtgtgcgcttacgtgatgggattcgcgtggtcatggggaccattaggatggctaattcctagcgagacgtttcctctagagactcgaagtgcagggttcgctgttgcagtctcgtgcaacatgttattcaccttcgtgatcgcgcaggctttcttgtcgatgctttgtgggatgagatcaggaatattcttcttcttcagcgcttggatcattgtgatgggactgtttgctttgttctttataccggagactaaaggtgtggccattgatgatgtgagggagagagtgtggaagccacactggttctggaaaaggtatatgcttgctgaggatgatcatcaagatgtggagaagagaactgaatga

SEQ ID NO: 99 - protein, 508 aa, Brassica napus
MAVVVSANGNGPAFEAKMTVYVFVCVLIAAVGGLIFGYDIGISGGVTAMDDFLKKFFPTVWERKQHAHENNYCKYDNQHLQLFTSSLYLAALVASFLASAVCSKLGRKPTMQFASVFFLIGVGLAAGADNIVMLIIGRILLGFGVGFGNQAVPLFLSEIAPAQLRGGLNIVFQLMVTIGILIANLVNYFTATVHPNGWRIALGGAAIPAVILLLGSLIICETPTSLIERNKNEEGRETLRKIRGVEDINDEYESIVHACEIASQVKDPYRKLLKPASRPPLIIGMLLQLFQQFSGINAIMFYAPVLFQTVGFGNNAALLSAVITGSINVLSTFVGIYLVDRTGRRFLLLQSSVHMLISQLIIGIILAKDLGITGTLGKAQAMVVVVFVCAYVMGFAWSWGPLGWLIPSETFPLETRSAGFAVAVSCNMLFTFVIAQAFLSMLCGMRSGIFFFFSAWIIVMGLFALFFIPETKGVAIDDVRERVWKPHWFWKRYMLAEDDHQDVEKRTE

SEQ ID NO: 100 - DNA, 1596 bp, Brassica napus
  CDS (1)..(1596)
atgacaggtttgacgccggaaactcaaacagtcccgacgacggcaccggcaacaaaacatgtaccggagttaggtccaccgttgaaaccaaagaggaacaagtatgcattcgcgtgtgcaatcttagcttccatgacttccatcctccttggttatgatataggagtgatgagtggagcactgatctatatcaagagagatttcaaaatcactgatcttcaagtcagtattctcgccggaatacttaacattttttcactcatcggttcttgtgccgccggtaaaacgtccgactggattggtcggcgtaacacaatcgtgtttgccggagctatattcttcgccggagcaatcctcatgggattggctcctaactacgatttcctcatgttcgggaggtttgtcgccggagtaggagtcggttatgctctcatgattgcacctgtctataccgccgaagtcgctccggcatcttctcgtggctttctcacctccttccctgaggtgttcatcaacgcaggaataatgctcgggtatgtatcaaacctcgccttctccaagtttcctctgaagcttggatggagattcatgctcggcgtcggttctgttccttccgtcttactagcgatcggcgttctcgccatgccggaatctccacggtggctcgttatacaaggccgtctaggagaagccaaacgcgtcctcgacaaaacctctgattctccctctgaagccgctcttcgcctcgaagaaatcaaagaagccgccggaatccccgccgattgccatgacgacgtcgttcaggtttcgaggaagaccagccacggcagcggagtatggaaagagcttctaatccgtccgactccagccgtccgccgcgtcatgatcgccgcgatgggaatccatttcttccagcaagccaccgggatcgacgcggtggtcctcttctcaccacgaatcttcaaaaccgccggactcaaaacagatcaccagcagcttctagcgaccgtagcagtaggagtagtgaaaacatcattcatactagtggccactttcctcatcgaccgagtcggaagacggccactgcttctcaccagcgtgggaggcatgatcctgtctctcgcggcgttgggaacatctctaacgataatagaccacacagagaagaaagtgacgtgggctttggtgctaagcatcactacggtgatgacttacgtagctacgttctcgataggagctggacctatcacatgggtttacacctctgagatattcccgttgaggttgaggtcacaggggtcgagtatggccgtggtggtgaacagagtgacgagcggtgtgatctccatgacgtttcttttgctgtcgaaggcgatgacgacgggaggagcgttttacttgtttggagggattgcgacggtggcttgggtgtttttctacactttcttgccggagacgcaagggaggtcgcttgaggatatggatgagctttttagtggcttcaggtggagagactccaagagtaagcctaagaacaacaagaactccagttcgaacccgcaggttgagattggaccaaacaaactgagagcataa

SEQ ID NO: 101 - protein, 531 aa, Brassica napus
MTGLTPETQTVPTTAPATKHVPELGPPLKPKRNKYAFACAILASMTSILLGYDIGVMSGALIYIKRDFKITDLQVSILAGILNIFSLIGSCAAGKTSDWIGRRNTIVFAGAIFFAGAILMGLAPNYDFLMFGRFVAGVGVGYALMIAPVYTAEVAPASSRGFLTSFPEVFINAGIMLGYVSNLAFSKFPLKLGWRFMLGVGSVPSVLLAIGVLAMPESPRWLVIQGRLGEAKRVLDKTSDSPSEAALRLEEIKEAAGIPADCHDDVVQVSRKTSHGSGVWKELLIRPTPAVRRVMIAAMGIHFFQQATGIDAVVLFSPRIFKTAGLKTDHQQLLATVAVGVVKTSFILVATFLIDRVGRRPLLLTSVGGMILSLAALGTSLTIIDHTEKKVTWALVLSITTVMTYVATFSIGAGPITWVYTSEIFPLRLRSQGSSMAVVVNRVTSGVISMTFLLLSKAMTTGGAFYLFGGIATVAWVFFYTFLPETQGRSLEDMDELFSGFRWRDSKSKPKNNKNSSSNPQVEIGPNKLRA

SEQ ID NO: 102 - DNA, 1635 bp, Brassica napus
  CDS (1)..(1635)
atgcaatcgtcaacgtacgcagctgttaaaggaaacgctgcgtttgcgtttcagagacgtagcttctctaacctcgtcagcagatcggcgactactaccggaattcgcttctccaccggctcttacttcgcacaactccactcttccgcctcgaaagccatgggagcgaagcttgctcgcgctgagaacgggattcacagtctctcctcggtcaaagctcgatcggttagagcacaagcctcctctggtggtggtgacgaagaagaagcaatacctctgagatctgaaggaaaaatctcagggacggttttacccttcgttggtgttgcttgtcttggtgctatcttgtttggttatcatctcggggttgttaacggtgctcttgagtaccttgctaaggatcttggtatcgctgataatgctgttttgcaagggtggattgttagcgcgttgcttgctggtgcaacggtcggttctttcaccggaggtgcattagctgacaaatttggaagaactagaacttttcaattggatgctatcccgcttgctattggagctttcttatgtgcaacagctcagagtgtgcagactatgattgtgggacgtctgctcgcaggggttggaatcggaatctcatcagccattgtaccactttacatctccgagatatcaccaactgaaattcgcggtgcactcggatctgtgaaccagttgttcatatgtattggaatactcgcagccttgatagctggattaccccttgcagcaaaccctctatggtggaggacgatgtttggtgttgcagttatcccttccgttctattagccataggaatggggttttctccagaaagcccaaggtggctcgttcagcaaggaaaacttactcaagcggaaaaggctatcaaaactctgtatggtaaagaaaaagtggttgaactagtgcgtgacttatcaaactctggccaaggtacttctgagccagaggcaggatggtttgatctattcagcagccgctactggaaagttgtaagcgttggtgcggcgctcttcttgtttcagcagttagctgggataaatgcagttgtgtactactctacatctgtgttccgcagcgccggaatccaatctgatgttgcagccagtgctcttgttggagcatcaaacgtgtttggaactgctgttgcttcgtctttgatggacaaaatgggaaggaaaagtcttctacttactagctttggtggaatggcgttgtctatgctgttgctctcgttgtccttcacatggaaggctcttgctgcatattctggcactcttgctgttgttggaactgttctatatgtcctgtcattttcgcttggtgctggcccagtaccggctcttttgcttccagagatattcgcatccaggatcagagcaaaagccgtcgctctttctctcggcatgcactggatctcaaactttgtgattggactctacttcttgagcgttgtgactaaattcggaatcagcagtgtctacttgggattcgcaggagtgtgtgtccttgcagtcatgtacattgcaggaaacgtggtggagactaaaggacggtcactcgaggaaatagagcttgctcttacatccggagcttaa

SEQ ID NO: 103 - protein, 544 aa, Brassica napus
MQSSTYAAVKGNAAFAFQRRSFSNLVSRSATTTGIRFSTGSYFAQLHSSASKAMGAKLARAENGIHSLSSVKARSVRAQASSGGGDEEEAIPLRSEGKISGTVLPFVGVACLGAILFGYHLGVVNGALEYLAKDLGIADNAVLQGWIVSALLAGATVGSFTGGALADKFGRTRTFQLDAIPLAIGAFLCATAQSVQTMIVGRLLAGVGIGISSAIVPLYISEISPTEIRGALGSVNQLFICIGILAALIAGLPLAANPLWWRTMFGVAVIPSVLLAIGMGFSPESPRWLVQQGKLTQAEKAIKTLYGKEKVVELVRDLSNSGQGTSEPEAGWFDLFSSRYWKVVSVGAALFLFQQLAGINAVVYYSTSVFRSAGIQSDVAASALVGASNVFGTAVASSLMDKMGRKSLLLTSFGGMALSMLLLSLSFTWKALAAYSGTLAVVGTVLYVLSFSLGAGPVPALLLPEIFASRIRAKAVALSLGMHWISNFVIGLYFLSVVTKFGISSVYLGFAGVCVLAVMYIAGNVVETKGRSLEEIELALTSGA

SEQ ID NO: 104 - DNA, 1428 bp, Brassica napus
  CDS (1)..(1428)
atgatggtggtcgaagaagaaagaagtatggaggaagggcttctcaagctgaagaaccaaaacgacacttcagactgtcgtattactgcctgtgttatcctcagcacttttgtcgccgtatgcggctccttttcctttggtgttgctgttggttatacttcaggtgctgagataggaattatgcaagacatgggcctttctattgcagaattttcagcatttggctcattctgcacgttgggagctgcagtcggtgcgctgttcagcggtaaaatggcgatcatgctaggaagaagaggaacaatgtgggtgtccaatatcctctgcatcactggttggctatccatagctttcgctaaggatgtgttgtggctggactttggaagaatatcatcagggataggaatcggcttgattagctatgtggtacctgtctacatagccgaaattacgccaaaacatgttcgcggtacatttaccttttcaaatcagcttcttcaaaacgctggagtctccatggtttatttttgcgggaatttcttggagtggaggatgatggctttactaagtgctttaccatgcgtcattcaagcaatcggtttattctttgtaccagaatccccaagatggctggcaaaagttggtacggaaaaagaactagaaaattcactgcttcggcttagagggagagatgctgatatttcacatgaagcttcagagattcaacttatgaccagaatggtagaaagtgattcaaagtcaagcttttctgatttgttccagagaaagtatagacatactctcgtggtaggaatcgggctaatgttaatacaacagttctcaggaagtgctgctgtaatctcttatgcaagtaccatttttagaaaagctggtttttcggttgccattggatctacgatgttaggcctattcatgataccaaaagccatgattggtctaattcttgtagataaatggggcagacggcccctcttgttgacttctgcctgtgggatgaccataactagcatgcttcttggactcgctttcgcattacagaaaatgcaattacttccagaactaactccagtattcacgtttatctgcgttacgctgtatattgcaacttatgcaataggcgtgggaggcctcccttgggtaataatgtcagagatatttccaataaatataaaagtaacagcagggagtttagttacgttagcctcatggtcaagtagttccatcgtcacttacgctttcaactttctattcgaatggagcactcaaggaacattttacatattcggggctatcggaggaggagcgttgctttttatttggctgctcgttccggaaacgaaaggattatcacttgaagaaatacaaatttcgcttacaggtcagcccgatgagataagccatatgtag

SEQ ID NO: 105 - protein, 475 aa, Brassica napus
MMVVEEERSMEEGLLKLKNQNDTSDCRITACVILSTFVAVCGSFSFGVAVGYTSGAEIGIMQDMGLSIAEFSAFGSFCTLGAAVGALFSGKMAIMLGRRGTMWVSNILCITGWLSIAFAKDVLWLDFGRISSGIGIGLISYVVPVYIAEITPKHVRGTFTFSNQLLQNAGVSMVYFCGNFLEWRMMALLSALPCVIQAIGLFFVPESPRWLAKVGTEKELENSLLRLRGRDADISHEASEIQLMTRMVESDSKSSFSDLFQRKYRHTLVVGIGLMLIQQFSGSAAVISYASTIFRKAGFSVAIGSTMLGLFMIPKAMIGLILVDKWGRRPLLLTSACGMTITSMLLGLAFALQKMQLLPELTPVFTFICVTLYIATYAIGVGGLPWVIMSEIFPINIKVTAGSLVTLASWSSSSIVTYAFNFLFEWSTQGTFYIFGAIGGGALLFIWLLVPETKGLSLEEIQISLTGQPDEISHM

SEQ ID NO: 106 - DNA, 1530 bp, Triticum aestivum
  CDS (1)..(1530)
atgacgatcgatttgtccaccatgcccgggagctcctcctcccgtctcctggacgccgccgcggcgaggaaggacatgaacttcttcaaaaaccgctacgtgcttgggctcaccggcgtcgccggaatcggcgggttcctctttggatacgacacaggtgttatatctggagcgcttctgtatattcgggacgaatttccagctgtcaaagacaatctattcttgcaggagacaattgttagcatggcattacttggagccatgcttggagcagctgggggcggttggataaatgatgcctacggtcgtaaaaagtccactcttcttgctgacctgatgttcgcacttggttcactggttatgtgtgctgctggcggtccttacattctgatacttggaaggctctttgttggattgggtgtgggaatagcatcagtcactgccccagtttacatcgctgaagctgctccttcagaaatcaggggaggtttggtgtcaactaatgtcctcatgattactggcggccaattcttctcctacttggtcaatcttggctttaccgaggttcctgggacatggcgctggatgctcggagtagctgctgtgccagcaatcatacagtttgtgctgatgctttttctgccagaatctccccgctggctttaccggaaggatgagaaagcaaaagctattgctgtcctggagcagatatatgactctggtcgtctggaggaagaggttgagctgcttgcgtcggcttccatgcatgaattccagtctaactgtactgggagctatttggacatattcaggttgaaggaattaaggctagctttttttgctggagctggtcttcaggcctttcagcaatttactggcatcaacaccgtcatgtactacagccccacgatcgtccagatggctgggttcacttccaacaggctggccctgctactttccctcatcgttgccgccatgaatgcgagtggaaccatcgtcggaatctacctcatcgaccgttgtggccgccgccgcctggcccttacaagcctagccggggtcgtgctctcccttgtcatcctcgccacggccttcatactgcagtcatcctccagcctctgcgggagcctgttcagcggctcctgccaaggcgtgctggggtggttcgcggtcggagggctcgctctgtacatcgccttcttctctccgggcatggggccggtgccatgggccgtgaactcggagatctaccccgaggcctaccgcggcatgtgcggcggcatgtcggccaccgtcaactggatctccaacctgatcgtggcgcagacgttcctctcgatcgtggggtgggtcggcaccggcccaacattcataatcatcgccgggatagccgtgatggccttgatcttcgtcgccctctacgtgccggagaccaagggcctgagcttcgaggaggtggacctcctgtggaaagagcgggcctggggaagccagggcagccacgagagcctcctgggtgctgcgccgtaa

SEQ ID NO: 107 - protein, 509 aa, Triticum aestivum
MTIDLSTMPGSSSSRLLDAAAARKDMNFFKNRYVLGLTGVAGIGGFLFGYDTGVISGALLYIRDEFPAVKDNLFLQETIVSMALLGAMLGAAGGGWINDAYGRKKSTLLADLMFALGSLVMCAAGGPYILILGRLFVGLGVGIASVTAPVYIAEAAPSEIRGGLVSTNVLMITGGQFFSYLVNLGFTEVPGTWRWMLGVAAVPAIIQFVLMLFLPESPRWLYRKDEKAKAIAVLEQIYDSGRLEEEVELLASASMHEFQSNCTGSYLDIFRLKELRLAFFAGAGLQAFQQFTGINTVMYYSPTIVQMAGFTSNRLALLLSLIVAAMNASGTIVGIYLIDRCGRRRLALTSLAGVVLSLVILATAFILQSSSSLCGSLFSGSCQGVLGWFAVGGLALYIAFFSPGMGPVPWAVNSEIYPEAYRGMCGGMSATVNWISNLIVAQTFLSIVGWVGTGPTFIIIAGIAVMALIFVALYVPETKGLSFEEVDLLWKERAWGSQGSHESLLGAAP

SEQ ID NO: 108 - DNA, 1458 bp, Zea mays
  CDS (1)..(1458)
atgcggtggaagcttaactcctccgtctacaagcgcgtgccgtccagggaaaccgccatggaacccgacgtcgagacgccaatgagaatgacggacggcggcggcagcggcgcggggccgtcgtggcgcatgtcgttgccgcatgtctgtgtcgccacgctcacctcgttcctctttggataccactccggggtggtgaacgagcccttggaggtcatctccgctgaccttggcttcgccggcaacactcttgctgaagggctcgtggtgagtatctgtttgggaggagcttttgttgggtgcctcttcagcggctccatcgcagatggtattgggcgacgccgtgcgttccagctcagtgcgctgcctatgattattggtgctgccataagtgctctctccaatagtttggagggtatgctccttggaagatttttggtaggaacagggatgggattgggtccaccagtagcttcactttatataacggaggtttctccttctacagtgaggggtacatatggtagctttgttcagattgcaacctgccttggaattatagtatcactactcattggtacacctgtcaaagatattgatagatggtggagagtgtgtttctgggttgccgttatcccagcaactttacaagctctcggtatggagttttgtgctgagagccctcagtggctttataagtgtggaaaaataagtgaagcagagatgcaatttgaaaagcttttaggtccccttcatgtaaaatctgccatggcagaactttctagatatgaaagagtagatgatggagaaagtgtcaagtactcagagttgttctatggtcgccacttcaatgttgtttttattggcacaacgctctttgctttacaacagttatccggcataaattctgtgttctatttctcatcaactgtattcagaagtgtgggggtgccctctaaccttgccaacatatgcatggggatttctaatctatcaggatcaattgtagcaatgcttctaatggacaagctaggtagaaaagtgcttctttcagggagttttcttgggatggcttttgcaatggggcttcaggctgttggagcaaaccgtcagtatcttggttctgcatgtgtatatctttcagttggtggcattctgttgtttgtcttgtcattttcactaggagcaggccctgtcccaggacttcttttgcctgagattttccctaataaaatccgagctaaggctatggctctctgcatgtctgtacattggatcgtgaacttctttgttagtttgatgttcttgcgtcttctggagcaacttggtccacagcttctctacacaatattttcgtcagtctgtgtggtagcctcaatatttgtgaggcgccatgtgttggagacgaagggaaagactttacaagagatagaggtttcactcctgcaaccacaataa

SEQ ID NO: 109 - protein, 485 aa, Zea mays
MRWKLNSSVYKRVPSRETAMEPDVETPMRMTDGGGSGAGPSWRMSLPHVCVATLTSFLFGYHSGVVNEPLEVISADLGFAGNTLAEGLVVSICLGGAFVGCLFSGSIADGIGRRRAFQLSALPMIIGAAISALSNSLEGMLLGRFLVGTGMGLGPPVASLYITEVSPSTVRGTYGSFVQIATCLGIIVSLLIGTPVKDIDRWWRVCFWVAVIPATLQALGMEFCAESPQWLYKCGKISEAEMQFEKLLGPLHVKSAMAELSRYERVDDGESVKYSELFYGRHFNVVFIGTTLFALQQLSGINSVFYFSSTVFRSVGVPSNLANICMGISNLSGSIVAMLLMDKLGRKVLLSGSFLGMAFAMGLQAVGANRQYLGSACVYLSVGGILLFVLSFSLGAGPVPGLLLPEIFPNKIRAKAMALCMSVHWIVNFFVSLMFLRLLEQLGPQLLYTIFSSVCVVASIFVRRHVLETKGKTLQEIEVSLLQPQ

SEQ ID NO: 110 - DNA, 1524 bp, Glycine max
  CDS (1)..(1524)
atggaagttccaatcaagtatccggcaaaactcacccttagggtggttcttacttgtatcatggcggccaccggtgggttgatttttggctatgaccatggtgtttcaggtggagtgacctccatggattccttcctgaagaagttcttcccatctgtatatgaaaaggagtctaacgtgaagccttcttcaaaccagtactgcaaattcaacagtcagatactgacactgtttacatcttccctttatctaagtgctcttgctgcgggtcttggggcatccagcataacccgaatgttgggaagacgtgcaactatgattatgggtggaatattctttgtggcaggtgcattactcaatggattagctgtaagcatctggatgcttattgttggcaggttgttgcttggttttggcattggttgtgccaatcagtcagttccaatctatgtgtcagagatggccccttataaataccgtggagctctaaacatgtgcttccaattgtcaatcacaataggcatctttgtggccaatctcttcaactactacttttccaagatactgaatggtcagggatggcgcttaagcctggggctaggtgcagtccctgctttcatttttgttataggctcattttgccttcctgactcaccaagctcccttgttgaacgtggtcttcatgaagatgccaaaagggagcttgtaaaaattcgtggtacaactgaagttgatgcagaattcagggacatacttgctgctagtgaagcctcacagaatgtgaaacacccttggagaaccttgatggatagaaagtataggccacagcttgtttttgccatttgcattcccttcttccaacagttcactggcttgaatgtgatcacattctatgctcctattttgttcagaacaattggttttggaagcggggcatctctcatgtctgcagtgatcattggcagctttaaacctgtttcaaccctggtttcaattcttcttgtcgataaatttggaagacgcacccttttcctggagggtggtgctcaaatgttgatttgccagatcatcatgacaattgctattgcggttacatttggcacaaatgggaacccaggtacactgcctaagtggtatgcaatcgtggttgtggggatcatctgtgtgtatgtttcaggttttgcttggtcatggggtcctctaggctggttgatacctagtgaaatctttccccttgagattagacctgctgctcagagtatcacagttggtgtcaacatgatcagcactttcttcatagctcaattcttcacatcaatgctctgtcacatgaagtttggtttgttcatcttctttgggtgctttgtggtgatcatgaccttattcatctacaagttattgcctgagacaaagggcatcccacttgaggaaatgagtatggtttggcagaaacaccccatctggggcaaatttttggagtcggacaaccccatccaaaacgacaaaatgaactccaaatgttga

SEQ ID NO: 111 - protein, 507 aa, Glycine max
MEVPIKYPAKLTLRVVLTCIMAATGGLIFGYDHGVSGGVTSMDSFLKKFFPSVYEKESNVKPSSNQYCKFNSQILTLFTSSLYLSALAAGLGASSITRMLGRRATMIMGGIFFVAGALLNGLAVSIWMLIVGRLLLGFGIGCANQSVPIYVSEMAPYKYRGALNMCFQLSITIGIFVANLFNYYFSKILNGQGWRLSLGLGAVPAFIFVIGSFCLPDSPSSLVERGLHEDAKRELVKIRGTTEVDAEFRDILAASEASQNVKHPWRTLMDRKYRPQLVFAICIPFFQQFTGLNVITFYAPILFRTIGFGSGASLMSAVIIGSFKPVSTLVSILLVDKFGRRTLFLEGGAQMLICQIIMTIAIAVTFGTNGNPGTLPKWYAIVVVGIICVYVSGFAWSWGPLGWLIPSEIFPLEIRPAAQSITVGVNMISTFFIAQFFTSMLCHMKFGLFIFFGCFVVIMTLFIYKLLPETKGIPLEEMSMVWQKHPIWGKFLESDNPIQNDKMNSKC

SEQ ID NO: 112 - DNA, 1659 bp, Glycine max
  CDS (1)..(1659)
atggcatcaactactctcttcagcttcagactctctttgaacccactgcaccatcaacagacaacgaggccaaaatctctgctctcctctcctcgcaccaatccacgcctcgtttcttccattaacaatcatttggccctcacacgtgtcacatacccgcttctccaatctcactctgctcctaagcgcagattccatgtgtattctgatggggaaagctccgagtcgcttgtttctgacgctacataccaagaggaattttcttggtcttctgtaattcttccgtttctgttccctgcgttgggtggcttattatttggctatgatattggagccacctctggcgctacaatttcactgcagtcacctgagcttagcggtatatcatggtttaaactttctgctattcagcttggactagtggttagtggttccctatatggggctcttcttggctcgcttgttgcatttgccatagctgatttccttgggaggaagaaacaactcattactgcagcactgttgtatttgtttggtggtgtgattactgcctatgcaccagaacttggtgttctcttagcaggaaggctgctttatggacttggtataggtttggccatgcatggggctcctttatatattgcggagacttgtccatcacaaatccgtgggactttagtatcattaaaagaactcttcattgtcctggggattctgctgggttattttgtgggaagctttctgattgagaccgttgggggatggcggttcatgtatggatttagtgctccagttgctgtattaatggggcttggaatgttgactctccccaattctccacggtggttgcttctcagagcagtgcaaggaaaaggttcttttcaagatttgaaggaaaaggccattttttccctgagcaaattaaggggccgaccacctggtgacaaagaatccgagagacaagtagaagaaacccttgtctcattgaagtctgcctatgcagataaggaatcggaggggaatttcttagaggtgtttcagggtccgaatctgaaagctttcataattggtgggggactagtcttatttcaacagataacaggtcaaccaagtgttctgtactatgcaggtccaattcttcagagtgctggattttctgctgcatccgatgctacaaaagtttcggttgttattggcctattcaagttgctaatgacttggattgctgtcctaaaagttgatgatttggggagaagacctctgctgattggaggtgtcagtggcattgccctttctctagttctcctttctgcttattataaatttcttggaggtttcccacttgttgctgttggagctttacttctttatgttggttgctaccagatatcatttgggccgataagttggctaatggtatcagaggtcttcccacttcgcactagaggaaaggggattagtctggctgttcttaccaacttcgcttcaaatgctgttgtcacctttgcattctccccgctaaaggagtttctaggagcagaaaatctttttctcctttttggggctattgctattctatcacttttgttcattatcttttctgtcccagagacaaaaggcttgagtttagaagatatagaatccaaaatcttgaagtga

SEQ ID NO: 113 - protein, 552 aa, Glycine max
MASTTLFSFRLSLNPLHHQQTTRPKSLLSSPRTNPRLVSSINNHLALTRVTYPLLQSHSAPKRRFHVYSDGESSESLVSDATYQEEFSWSSVILPFLFPALGGLLFGYDIGATSGATISLQSPELSGISWFKLSAIQLGLVVSGSLYGALLGSLVAFAIADFLGRKKQLITAALLYLFGGVITAYAPELGVLLAGRLLYGLGIGLAMHGAPLYIAETCPSQIRGTLVSLKELFIVLGILLGYFVGSFLIETVGGWRFMYGFSAPVAVLMGLGMLTLPNSPRWLLLRAVQGKGSFQDLKEKAIFSLSKLRGRPPGDKESERQVEETLVSLKSAYADKESEGNFLEVFQGPNLKAFIIGGGLVLFQQITGQPSVLYYAGPILQSAGFSAASDATKVSVVIGLFKLLMTWIAVLKVDDLGRRPLLIGGVSGIALSLVLLSAYYKFLGGFPLVAVGALLLYVGCYQISFGPISWLMVSEVFPLRTRGKGISLAVLTNFASNAVVTFAFSPLKEFLGAENLFLLFGAIAILSLLFIIFSVPETKGLSLEDIESKILK

SEQ ID NO: 114 - DNA, 1452 bp, Glycine max
  CDS (1)..(1452)
atgtgggtgggacattcatctatgtacaagcgcactccttcgagagataattcaaacatggaggacatggaagaaaactcagacatcggcctggacaagggaacatcaaatccttcattgatgctttctttaccgcatgtacttgtggcgaccatttcttcattcctttttggataccatctgggggttgttaatgaaccacttgagagcatttctgtggatcttggcttccgtggaaatacattggcagaaggtctggtggtgagcatatgccttggtggtgccttgattggatgtctactaagtggttggattgctgatggggtggggcgtcgtagggctttccagttgtgtgctctgccaatgataattggtgcttctatgagtgcagcaacaaacaacttgtttggcatgcttgtaggaaggttgtttgttgggactggcttgggcctgggccctcctgttgcctctctgtatgtgacagaggtttctcctgcttttgtgcggggcacctttggagctttcatccagattgcaacatgccttggtctaatgggagctttatttattggaatccctgtcaaagaaatttctggatggtggcgggtttgtttttgggtatctaccattccagctgctatacttgccgcagctatggtcttctgcgcagagagtccgcattggttatacaagcaaggaagaactgctgaagcagaagctgagtttgagagacttctgggtgtatcagaagcaaaatttgcaatgtcggagttatccaaggtagatagaagtgatgatactgatactgtaaagctgtcggaattgcttcatggtcgtcattctaaagttgtttttattggatcaaccctatttgctttacaacagctatctggtataaatgctgggttttatttctcttcaactgtttttaaaagtgctggagtcccatcagacattgcaaatgtctgcataggaatcgctaatttggcaggatctatcgtttcaatgggtttgatggataagcttggaaggaaggttctacttttctggagtttctttggcatggcaatagcaatgatccttcaagccacaggagcaacttcacttgtatcaaacgtgggagctcagtacttttctgttggtggcatgttactgtttgtcttaacatttgctctgggggctggtccagttccaggtctccttctaccagaaatctttcctagtcgaataagagccaaagccatggcagtctgtatgtcagtgcattgggtgataaatttctttgttggactactgttcttgcgtttgctggagaaacttggtccacagctgctttactccatgtttgctaccttttgcatcatggcagtaacttttgtaaaaagaaatgtggtggaaaccaaagggaagtcacttcatgaaattgagatcgcacttcttcctcaagactag

SEQ ID NO: 115 - protein, 483 aa, Glycine max
MWVGHSSMYKRTPSRDNSNMEDMEENSDIGLDKGTSNPSLMLSLPHVLVATISSFLFGYHLGVVNEPLESISVDLGFRGNTLAEGLVVSICLGGALIGCLLSGWIADGVGRRRAFQLCALPMIIGASMSAATNNLFGMLVGRLFVGTGLGLGPPVASLYVTEVSPAFVRGTFGAFIQIATCLGLMGALFIGIPVKEISGWWRVCFWVSTIPAAILAAAMVFCAESPHWLYKQGRTAEAEAEFERLLGVSEAKFAMSELSKVDRSDDTDTVKLSELLHGRHSKVVFIGSTLFALQQLSGINAGFYFSSTVFKSAGVPSDIANVCIGIANLAGSIVSMGLMDKLGRKVLLFWSFFGMAIAMILQATGATSLVSNVGAQYFSVGGMLLFVLTFALGAGPVPGLLLPEIFPSRIRAKAMAVCMSVHWVINFFVGLLFLRLLEKLGPQLLYSMFATFCIMAVTFVKRNVVETKGKSLHEIEIALLPQD

SEQ ID NO: 116 - DNA, 1620 bp, Zea mays
  CDS (1)..(1620)
atgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaattggtatcggggtctcatctgctcttgtacccctttacatatctgagatctcaccaactgaaattcgtggaacacttggtaccgttaatcaactttttatttgcattggaattcttgcagctttgttagctggattgcctctggcaggaaatcctgcctggtggaggacaatgtttggaattgctgtagttccatccattctgctggctgtaggaatggccttttcgcctgaaagccctcgttggctattccagcaaggaaaggttactcaagcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgttgtatattactctacatcggtgttccgtagtgcaggcattgcatctgatgttgctgctagtgctcttgttggagcagccaatgtttttggtactatggttgcatcttctctaatggacaaacaaggaaggaaaagccttctgataacaagcttttctggaatgggtgcttcaatgctactcctagcattgtccttcacctggaaagctctggcaccttattctggtactcttgctgtcgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtcagcaagtttgggatcagcaacgtgtatctgggatttgcatcagtatgtgcccttgcagttctgtacatagctgggaatgtggtcgagaccaaggggagatcacttgaagagattgaaagggagttaagtgtagcagaatga

SEQ ID NO: 117 - protein, 539 aa, Zea mays
MMRCAATGGGCVASWSGDWRLPAVNPCSVRMPTGNDGWCAGLRSRAADLAGLEMANLRGGVGGLFRASPRYGRLQATAAVDPEDIPLEKVQVKSSGHVLPYVGVACLGAILFGYHLGVVNGALEYLAKDLGIAENAVLQGWVVSTSLAGATLGSFTGGSLADKFGRTRTFILDAVPLALGAFLSATAQDIRTMIIGRLLAGIGIGVSSALVPLYISEISPTEIRGTLGTVNQLFICIGILAALLAGLPLAGNPAWWRTMFGIAVVPSILLAVGMAFSPESPRWLFQQGKVTQAELAVKRLYGKEMVTEIMFDLRASGQSSSESEAGWFDLFSKRYWKVVSVGAALFLFQQLAGINAVVYYSTSVFRSAGIASDVAASALVGAANVFGTMVASSLMDKQGRKSLLITSFSGMGASMLLLALSFTWKALAPYSGTLAVVGTVLYVLSFALGAGPVPALLLPEIFASRIRAKAVALSLGMHWVSNFFIGLYFLSVVSKFGISNVYLGFASVCALAVLYIAGNVVETKGRSLEEIERELSVAE

SEQ ID NO: 118 - DNA, 21 bp, Artificial sequence
  primer
atgcaaccgtccagaaacttt

SEQ ID NO: 119 - DNA, 21 bp, Artificial sequence
  primer
ttaccccattctctgcccgcg

SEQ ID NO: 120 - protein, 507 aa, Artificial sequence
  consensus sequence
  Variant (3)..(32): Xaa in position 3 to 32 is any amino acid
  Variant (33)..(44): Xaa in position 33 to 44 is any or no amino acid
  Variant (46)..(48): Xaa in position 46 to 48 is any amino acid
  Variant (50)..(53): Xaa in position 50 to 53 is any amino acid
  Variant (55)..(57): Xaa in position 55 to 57 is any amino acid
  Variant (59)..(60): Xaa in position 59 to 60 is any amino acid
  Variant (63)..(88): Xaa in position 63 to 88 is any amino acid
  Variant (89)..(94): Xaa in position 89 to 94 is any or no amino acid
  Variant (96)..(98): Xaa in position 96 to 98 is any amino acid
  Variant (100)..(102): Xaa in position 100 to 102 is any amino acid
  Variant (104)..(106): Xaa in position 104 to 106 is any amino acid
  Variant (108)..(118): Xaa in position 108 to 118 is any amino acid
  Variant (120)..(121): Xaa in position 120 to 121 is any amino acid
  Variant (123)..(125): Xaa in position 123 to 125 is any amino acid
  Variant (128)..(139): Xaa in position 128 to 139 is any amino acid
  Variant (141)..(152): Xaa in position 141 to 152 is any amino acid
  Variant (153)..(179): Xaa in position 153 to 179 is any or no amino acid
  Variant (182)..(201): Xaa in position 182 to 201 is any amino acid
  Variant (209)..(210): Xaa in position 209 to 210 is any amino acid
  Variant (211)..(211): Xaa in position 211 is any or no amino acid
  Variant (213)..(216): Xaa in position 213 to 216 is any amino acid
  Variant (217)..(225): Xaa in position 217 to 225 is any or no amino acid
  Variant (227)..(309): Xaa in position 227 to 309 is any amino acid
  Variant (310)..(340): Xaa in position 310 to 340 is any or no amino acid
  Variant (342)..(352): Xaa in position 342 to 352 is any amino acid
  Variant (355)..(405): Xaa in position 355 to 405 is any amino acid
  Variant (406)..(425): Xaa in position 406 to 425 is any or no amino acid
  Variant (427)..(427): Xaa in position 427 is any amino acid
  Variant (430)..(432): Xaa in position 430 to 432 is any amino acid
  Variant (434)..(452): Xaa in position 434 to 452 is any amino acid
  Variant (453)..(475): Xaa in position 453 to 475 is any or no amino acid
  Variant (477)..(499): Xaa in position 477 to 499 is any amino acid
  Variant (500)..(500): Xaa in position 500 is any or no amino acid
  Variant (503)..(506): Xaa in position 503 to 506 is any amino acid
GYXXXXXXXXXXXXXXXXXXXXXXXXXXXXXXXXXXXXXXXXXXGXXXGXXXXGXXXDXXGRXXXXXXXXXXXXXXXXXXXXXXXXXXXXXXXXLXXXRXXXGXXXGXXXXXXXXXXXEXXPXXXRGXXXXXXXXXXXXGXXXXXXXXXXXXXXXXXXXXXXXXXXXXXXXXXXXXXXXWRXXXXXXXXXXXXXXXXXXXXPESPRWLXXXGXXXXXXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXGRXXXXXXXXXXXXXXXXXXXXXXXXXXXXXXXXXXXXXXXXXXXXXXXXXXXXXXXXXXXXXXXXXXXXXXXEXFPXXXRXXXXXXXXXXXXXXXXXXXXXXXXXXXXXXXXXXXXXXXXXXGXXXXXXXXXXXXXXXXXXXXXXXXETXXXXL

SEQ ID NO: 121 - protein, 33 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Phe, Ile, Leu or Val
  Variant (7)..(7): Xaa in position 7 is any amino acid
  Variant (8)..(8): Xaa in position 8 is Ala, Ile, Leu or Val
  Variant (10)..(10): Xaa in position 10 is any amino acid
  Variant (11)..(11): Xaa in position 11 is Ala, Gly or Val
  Variant (12)..(12): Xaa in position 12 is Ile, Leu, Met or Val
  Variant (14)..(14): Xaa in position 14 is any amino acid
  Variant (15)..(15): Xaa in position 15 is Ala, Asp, Glu or Gly
  Variant (16)..(18): Xaa in position 16 to 18 is any amino acid
  Variant (19)..(19): Xaa in position 19 is Ala, Gly, Ser or Val
  Variant (20)..(23): Xaa in position 20 to 23 is any amino acid
  Variant (24)..(24): Xaa in position 24 is Ala, Ser, Thr or Val
  Variant (26)..(27): Xaa in position 26 to 27 is any amino acid
  Variant (28)..(28): Xaa in position 28 is Asn, Pro or Ser
  Variant (29)..(31): Xaa in position 29 to 31 is any amino acid
  Variant (33)..(33): Xaa in position 33 is Ala or Gly
LXXXRXXXGXXXGXXXXXXXXXXXEXXXXXXRX

SEQ ID NO: 122 - protein, 27 aa, Artificial sequence
  protein pattern
  Variant (2)..(2): Xaa in position 2 is any amino acid
  Variant (5)..(7): Xaa in position 5 to 7 is any amino acid
  Variant (9)..(9): Xaa in position 9 is Ala, Gly, Pro or Ser
  Variant (10)..(10): Xaa in position 10 is any amino acid
  Variant (11)..(11): Xaa in position 11 is Ala, Cys or Gly
  Variant (12)..(12): Xaa in position 12 is any amino acid
  Variant (13)..(13): Xaa in position 13 is Ala, Gly or Ser
  Variant (14)..(22): Xaa in position 14 to 22 is any amino acid
  Variant (23)..(23): Xaa in position 23 is Ala, Gly, Asn, Ser or Thr
  Variant (24)..(26): Xaa in position 24 to 26 is any amino acid
  Variant (27)..(27): Xaa in position 27 is Ala, Gly, Ser, Thr or Val
EXFPXXXRXXXXXXXXXXXXXXXXXXX

SEQ ID NO: 123 - DNA, 456 bp, Escherichia coli
  CDS (1)..(456): transl_table=11
atgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgatggtaaagtagtttgcgaagcaacgatgatgtgtgctcgtagccgggaggcctaa

SEQ ID NO: 124 - protein, 151 aa, Escherichia coli
MTTNTHTLQIEEILELLPHRFPFLLVDRVLDFEEGRFLRAVKNVSVNEPFFQGHFPGKPIFPGVLILEAMAQATGILAFKSVGKLEPGELYYFAGIDEARFKRPVVPGDQMIMEVTFEKTRRGLTRFKGVALVDGKVVCEATMMCARSREA

SEQ ID NO: 125 - DNA, 1217 bp, Glycine max
  CDS (224)..(895)
  misc_feature (1187)..(1187): n is a, g, c or t
  misc_feature (1188)..(1188): n is a, g, c or t
  misc_feature (1189)..(1189): n is a, g, c or t
  misc_feature (1190)..(1190): n is a, g, c or t
  misc_feature (1191)..(1191): n is a, g, c or t
  misc_feature (1192)..(1192): n is a, g, c or t
  misc_feature (1193)..(1193): n is a, g, c or t
  misc_feature (1194)..(1194): n is a, g, c or t
  misc_feature (1195)..(1195): n is a, g, c or t
  misc_feature (1196)..(1196): n is a, g, c or t
  misc_feature (1197)..(1197): n is a, g, c or t
  misc_feature (1198)..(1198): n is a, g, c or t
  misc_feature (1199)..(1199): n is a, g, c or t
  misc_feature (1200)..(1200): n is a, g, c or t
  misc_feature (1201)..(1201): n is a, g, c or t
  misc_feature (1202)..(1202): n is a, g, c or t
  misc_feature (1203)..(1203): n is a, g, c or t
  misc_feature (1204)..(1204): n is a, g, c or t
  misc_feature (1205)..(1205): n is a, g, c or t
  misc_feature (1206)..(1206): n is a, g, c or t
  misc_feature (1207)..(1207): n is a, g, c or t
  misc_feature (1208)..(1208): n is a, g, c or t
  misc_feature (1209)..(1209): n is a, g, c or t
  misc_feature (1210)..(1210): n is a, g, c or t
  misc_feature (1211)..(1211): n is a, g, c or t
  misc_feature (1212)..(1212): n is a, g, c or t
  misc_feature (1213)..(1213): n is a, g, c or t
  misc_feature (1214)..(1214): n is a, g, c or t
  misc_feature (1215)..(1215): n is a, g, c or t
  misc_feature (1216)..(1216): n is a, g, c or t
cgccctaactgaaactcaaaaggtagcataagcgttagcattgctttccaacttgcacttccgtctcctttcagccttgaggattcagttctgtcttcaacttcattgtttctgtcgccttgctttgcttttaacgttaacctgcaattgcataaactttcaataactcagtgctcacgcttcaattacaagctttggtttttcacttcacgcttgaaacccaatggcagcctcagctttctccaacacattggtttctcccatttctcttccatccaaacccaaacccaaagccatttccttgcaacccaaatttccacttgtcaaattccccaaccccagatcccatcccttgtcgaggaaaacgacgtcgctcaccacgttttgttcctccgatgctgccaatgctcctcaacatgacaccccaattgaattaaggtatcccgcattcccaaccgtcatggacatcaaccagattcgtgacattttgccccacaggtttccttttcttctggtggatagagtgattgaatacaatcctggagtttctgcagtggccataaagaatgtgacaataaatgacaacttctttcctggacattttccagaaaggccaatcatgcctggtgttctaatggtcgaggcaatggcacaagttggtggtttggtcatgttgcaacctgaagtgggaggttctcgtgaaaacttcttctttgctggaatagacaaagtgcggtttcgtaagcctgtgatagctggggacaccttagttatgagaatgacacttactaagctgcaaaagcgatttggaatagcaaagatggaagggaaggcatatgttggaggtgaagttgtgtgtgagggtgaatttttgatggcaatggggagtgaataagtagacacattccttccaactggaatagagttgattttctagcatcttttaatttaatgcttctgccttttaatgcagaacatcgtgaacatttaatttaatgtatgcattttcaatgaaatttatctaagcattctgttctatttctatatggcttcgctttggctattcagtgcgaaaattatctttgatggatgaaaacttggcatttgaacttgtgtggttgtatccccatttgtttcaaagtatttgtttatggcaattcaatccttgtggacatttttttaccctnnnnnnnnnnnnnnnnnnnnnnnnnnnnnna

SEQ ID NO: 126 - protein, 223 aa, Glycine max
MAASAFSNTLVSPISLPSKPKPKAISLQPKFPLVKFPNPRSHPLSRKTTSLTTFCSSDAANAPQHDTPIELRYPAFPTVMDINQIRDILPHRFPFLLVDRVIEYNPGVSAVAIKNVTINDNFFPGHFPERPIMPGVLMVEAMAQVGGLVMLQPEVGGSRENFFFAGIDKVRFRKPVIAGDTLVMRMTLTKLQKRFGIAKMEGKAYVGGEVVCEGEFLMAMGSE

SEQ ID NO: 127 - DNA, 1088 bp, Zea mays
  CDS (187)..(846)
  misc_feature (7)..(7): n is a, g, c or t
ggatttncccagaccgcccctacatctaacaaaaaaaaaaaaaaaaaaaaaaaaaaaaaaaaaaaaaaaagggtacccccgccatcgcgtcgcgcccgccgctctcctctcctgccggcctgtccaacttcaaaagagcacgcgcttctgccccccgccctcctgcaccgctctccttccccgacgatggatcccgcagccatgttgagatccccgtgctctatcgtctcgccgggctccttattaaccgccccacttctcccagtacgcctcgccgtccagccacgccgccgagtgcctggttttattgcgccctccggcaggccgtccgtcgcgcggcgcgccgcggccggagacaagttcgaggccgagacgcccatagagaaaagtttccctcccttcccaactgtcatggacatcaaccagatccgtgacatcctgccacataggttcccgtttcttctggttgacagagttattgattacaaaccaggagaatatgctgttgcaatcaagaatgtgacaataaatgataacttcttcccagggcatttccctgaacgacccataatgcctggtgttctcatggtcgaggcaatggcccaggtcggaggaatagtgatgttgcagcctgaagtgggtggatctcgagagaacttcttttttgcggggatcgataaagtgaggttccggaagcccgtgatcgctggagacaccttgatcatgagaatgactctgatcaagctgcagaagagattcggaattgcaaagatggaagggaaagcttacgttggcgccgacctagtatgcgaaggggagttcttgatggctactggatcagaatgaaggcaggagacacatggattgatggatacataatatttcaagtttttactgtgaaatcagctttccagtctaataagttttgaactgtgtctgtaatagcggtgtaatgtcgttgccttgtagtcttagtgagtgttgctgtgttggtgtgtatgagtaacagggctctaaggttaacaaccactgccatggaatggaacaaatggaaactgacagcgcgtttggttgtttttagagcgttt

SEQ ID NO: 128 - protein, 219 aa, Zea mays
MDPAAMLRSPCSIVSPGSLLTAPLLPVRLAVQPRRRVPGFIAPSGRPSVARRAAAGDKFEAETPIEKSFPPFPTVMDINQIRDILPHRFPFLLVDRVIDYKPGEYAVAIKNVTINDNFFPGHFPERPIMPGVLMVEAMAQVGGIVMLQPEVGGSRENFFFAGIDKVRFRKPVIAGDTLIMRMTLIKLQKRFGIAKMEGKAYVGADLVCEGEFLMATGSE

SEQ ID NO: 129 - DNA, 823 bp, Arabidopsis thaliana
  CDS (21)..(680)
gtatcgagatcgaatcggcaatggctgcttcaagctccgttttcacagtatccccgtcgcgaaatcttgcagctattcctcttcatcagtccctatctccaccgttgcttagatccagctccgtcgcgtttcgtcccaaacgaagatccagctcactcgtcttatgctcaactgatgaaacaaagagcaccgcagagaaagagatcccaatcgaactaaggtatgaggcgtttccgacagtgatggacatcaataagatacaagagattttgcctcacagattcccatttctgttagttgatagagtgatagagtacacagctggtgtatctgcggtagctattaaaaacgttaccattaatgacaatttctttcctgggcatttccctgagagacctataatgcctggagttctcatggttgaggcaatggctcaagtgggaggtatagtgatgctacaaccagaagttggcggatctagaagcaacttcttctttgctggaatcgacaaagtcagattcaggaagccagtgattgcaggtgatacgctggtgatgaggatgacacttgtgaagttgcagaagcggtttgggatagcgaaaatggaagggaaagcatatgtagggaactctgtggtatgtgaaggagagttcttgatggctatgggaaaagaagagtgatcacgcctttgtttctttcttcttcatacgggccttgtggctgctaattagttgtcacatcctaagttgagtctcatttctatcttcaatttatgatgtttgtttgcacattatgattatattaaaaaagcaacttcagtttt

SEQ ID NO: 130 - protein, 219 aa, Arabidopsis thaliana
MAASSSVFTVSPSRNLAAIPLHQSLSPPLLRSSSVAFRPKRRSSSLVLCSTDETKSTAEKEIPIELRYEAFPTVMDINKIQEILPHRFPFLLVDRVIEYTAGVSAVAIKNVTINDNFFPGHFPERPIMPGVLMVEAMAQVGGIVMLQPEVGGSRSNFFFAGIDKVRFRKPVIAGDTLVMRMTLVKLQKRFGIAKMEGKAYVGNSVVCEGEFLMAMGKEE

SEQ ID NO: 131 - DNA, 660 bp, Arabidopsis thaliana
  CDS (223)..(660)
atggctgcttcaagctccgttttcacagtatccccgtcgcgaaatcttgcagctattcctcttcatcagtccctatctccaccgttgcttagatccagctccgtcgcgtttcgtcccaaacgaagatccagctcactcgtcttatgctcaactgatgaatcaaagagcaccgcagagaaagagatcccaatcgaactaaggtatgaggcgtttccgacagtgatggacatcaataagatacaagagattttgcctcacagattcccatttctgttagttgatagagtgatagagtacacagctggtgtatctgcggtagctattaaaaacgttaccattaatgacaatttctttcctgggcatttccctgagagacctataatgcctggagttctcatggttgaggcaatggctcaagtgggaggtatagtgatgctacaaccagaagttggcggatctagaagcaacttcttctttgctggaatcgacaaagtcagattcaggaagccagtgattgcaggtgatacgctggtgatgaggatgacacttgtgaagttgcagaagcggtttgggatagcgaaaatggaagggaaagcatatgtagggaactctgtggtatgtgaaggagagttcttgatggctatgggaaaagaagagtga

SEQ ID NO: 132 - protein, 145 aa, Arabidopsis thaliana
MDINKIQEILPHRFPFLLVDRVIEYTAGVSAVAIKNVTINDNFFPGHFPERPIMPGVLMVEAMAQVGGIVMLQPEVGGSRSNFFFAGIDKVRFRKPVIAGDTLVMRMTLVKLQKRFGIAKMEGKAYVGNSVVCEGEFLMAMGKEE

SEQ ID NO: 133 - DNA, 663 bp, Arabidopsis thaliana
  CDS (226)..(663)
atggctactacttctaactcggtacttttcctaagttctgactcactgattcatcatcatcatcatcaacctctccatctatcttcctccagatctcactctgtttctctcccacccaacaagcgatccaattctctcacgcttcgttgttcaacaaatggcgatagcacctcaaccgaaaaggaaacaccaatcgaactcaaattcccagcatttccaacggtaatggacattaaccaaatcagagagatattgcctcacaggtttccgtttctgctggtagatagagtgatagagtatacgcctggtgtttcagctgtagctattaagaatgtcaccatcaatgacaatttcttccctggccatttccctgaacgaccaatcatgcctggtgttctcatgattgaggcaatggcgcaagtcggaggtatagtaatgctgcagccggaagtaggaggctctcaagataacttcttctttgctggtattgataaagtgagatttcgcaaaccagtgattgcaggagacacgctagtcatgaggatgactcttctcaagttccagaagcggttcgggctcgctaaaatggaaggtaaagcttatgtgggtggtgctctggtgtgtgaaggcgagttcatgatggtttctgctggtagttcttga

SEQ ID NO: 134 - protein, 145 aa, Arabidopsis thaliana
MDINQIREILPHRFPFLLVDRVIEYTPGVSAVAIKNVTINDNFFPGHFPERPIMPGVLMIEAMAQVGGIVMLQPEVGGSQDNFFFAGIDKVRFRKPVIAGDTLVMRMTLLKFQKRFGLAKMEGKAYVGGALVCEGEFMMVSAGSS

SEQ ID NO: 135 - DNA, 710 bp, Lactobacillus rhamnosus
  CDS (177)..(617): transl_table=11
atccatgaaaatgatgaatgagattaaaagtactgttagcggcacggttaaggcggttaaagtcgataacgaaagcttagttgaatacgaccagccgttgctcatcgtacaagaagacaaagcgtaaaccgagtcgcattccggctccataaacacgttttaggaggatagcattcatgctcgaaaccaaaaagacacttgaagcacaagaaattcaggcgattttgccacatcgttatcccatgttgatgattgaccgggtactggatctcaaacccggcgaatctgtggttgcacaaaagaacgtttctatcaatgaacagatttttcaagggcattttcccggtaacccgattttcccgggcgttttgcagatcgaagcgatggcgcaagcaggggcaattgctttgctttcgatgccagactttaaaggtaaaacagcttatctcggcggcattaagaaagccaagttccgtcacatggtacgccccggcgatgttttgcgcatcgaggtcactttagagaaattgatcgacaatgccggcttaggaaaaggcaaggtttacgtcggcgaagatatggcttgcagtgccgaacttgtctttgcaattggttaaatcgacccgattcagactcgtgtaaggaagtggaactgtgttcaaaaaagtactcgttgccaaccgtggcgagattgcggtccgtatcattca

SEQ ID NO: 136 - protein, 146 aa, Lactobacillus rhamnosus
MLETKKTLEAQEIQAILPHRYPMLMIDRVLDLKPGESVVAQKNVSINEQIFQGHFPGNPIFPGVLQIEAMAQAGAIALLSMPDFKGKTAYLGGIKKAKFRHMVRPGDVLRIEVTLEKLIDNAGLGKGKVYVGEDMACSAELVFAIG

SEQ ID NO: 137 - DNA, 453 bp, Legionella pneumophila
  CDS (1)..(453): transl_table=11
atgaacgaatcgatagatataaatcaaatttttactttgttaccacaccgctacccatttattctggttgatagagtgatagattacaaagtaatggaatatttgattgcaatcaaaaatgtgactattaatgagaacttctttaccgggcattttccaggaaatcctattatgcctggggtactaatgcttgaggccttagcccaagcttgtggcattttagccaatttgtctcgccaacccaaagaagggtatgagtttctgcattattttgctggtattgacaatgctcggttcaagcaagtagtgattcccggggatcaattgcgattagaggtgagactggctggacaaaaaagagatttttggcgtatgcacggagaagcttatattggagacaaattggcttgttccgcagacttattaagcgcagcaaaggaaattaaaaagtga

SEQ ID NO: 138 - protein, 150 aa, Legionella pneumophila
MNESIDINQIFTLLPHRYPFILVDRVIDYKVMEYLIAIKNVTINENFFTGHFPGNPIMPGVLMLEALAQACGILANLSRQPKEGYEFLHYFAGIDNARFKQVVIPGDQLRLEVRLAGQKRDFWRMHGEAYIGDKLACSADLLSAAKEIKK

SEQ ID NO: 139 - DNA, 1042 bp, Zea mays
  CDS (128)..(787)
cttggccacctcgtacgcatcggcatcgcgtcgcgcccgccgctctcctctcctgccggcctgtccaacttcaaaagagcacgcgcttccgccccccgccctcctgtaccgctctccttccccgacgatggatcccgcagccatgtcgagatccccgtgctctatcgtctcgccgggctccttattaaccgccccacttctcccagtacgcctcgccgtcaagccacgccgccgagtgcctgcttttattgcgccctccggcaggccgtccgtcgcgcggcgcgccgcggccggagacaagttcgaggccgagacgcccatagagaaaagtttccctcccttcccaactgtcatggacatcaaccagatccgtgacatcctgccacataggtttccgtttcttctggttgacagagttattgattacaaaccaggagaatatgctgttgcaatcaagaatgtgacaattaatgataacttcttcccagggcatttccctgaacgacccataatgcctggtgttctcatggtcgaggcaatggcccaggtcggaggaatagtgatgttgcagcctgaagtgggtggatctcgagagaacttcttttttgcggggatcgataaagtgaggttccggaagcccgtgatcgctggagacaccttgatcatgagaatgactctgatcaagctgcagaagagattcggaattgcaaagatggaagggaaagcttacgttggcgccgacctagtatgcgaaggggagttcttgatggctactggatcagaatgaaggcaggagacacatggattgatggatacataatatttcaagtttttactgtgaaatcagctttccagtctaataagttttgaactgtgtctgtaatagcggtgtaatgtcgttgccttgtagtcttagtgagtgttgctgtgttggtgtgtatgagtaacagggctctaaggttaacaaccactgccatggaatggaacaaatggaaactgacagcgcgtttggttgtttttagagcgtttaaaaaaaaaaaaa

SEQ ID NO: 140 - protein, 219 aa, Zea mays
MDPAAMSRSPCSIVSPGSLLTAPLLPVRLAVKPRRRVPAFIAPSGRPSVARRAAAGDKFEAETPIEKSFPPFPTVMDINQIRDILPHRFPFLLVDRVIDYKPGEYAVAIKNVTINDNFFPGHFPERPIMPGVLMVEAMAQVGGIVMLQPEVGGSRENFFFAGIDKVRFRKPVIAGDTLIMRMTLIKLQKRFGIAKMEGKAYVGADLVCEGEFLMATGSE

SEQ ID NO: 141 - DNA, 450 bp, Neisseria meningitidis FAM18
  CDS (1)..(450): transl_table=11
atggacgtacaactccccatcgaagccaaagacatccaaaaactcatcccccaccgctatccgtttctccagctcgaccgcatcaccgccttcgagccgatgaaaaccctgaccgcgattaaaaacgtcagcataaacgagccccagttccaaggccactttcccgacctgcccgtgatgcccggcgtactcatcatcgaagcgatggcgcaagcctgcggcacgttggcgattttgagcgaaggcgggcgcaaagaaaacgaattcttcttcttcgccggcatagacgaagcccgtttcaaacgccaagtcatccccggcgaccaactcgtctttgaagtcgagctgctgaccagccggcgcggcatcggcaaattcaacgccgttgccaaagtggacgggcaagtcgccgtcgaagccatcatcatgtgtgccaaacgcgtggtttga

SEQ ID NO: 142 - protein, 149 aa, Neisseria meningitidis FAM18
MDVQLPIEAKDIQKLIPHRYPFLQLDRITAFEPMKTLTAIKNVSINEPQFQGHFPDLPVMPGVLIIEAMAQACGTLAILSEGGRKENEFFFFAGIDEARFKRQVIPGDQLVFEVELLTSRRGIGKFNAVAKVDGQVAVEAIIMCAKRVV

SEQ ID NO: 143 - DNA, 660 bp, Arabidopsis thaliana; identical to SEQ ID NO: 131
  CDS (1)..(660)

SEQ ID NO: 144 - protein, 219 aa, Arabidopsis thaliana
MAASSSVFTVSPSRNLAAIPLHQSLSPPLLRSSSVAFRPKRRSSSLVLCSTDESKSTAEKEIPIELRYEAFPTVMDINKIQEILPHRFPFLLVDRVIEYTAGVSAVAIKNVTINDNFFPGHFPERPIMPGVLMVEAMAQVGGIVMLQPEVGGSRSNFFFAGIDKVRFRKPVIAGDTLVMRMTLVKLQKRFGIAKMEGKAYVGNSVVCEGEFLMAMGKEE

SEQ ID NO: 145 - DNA, 756 bp, Deinococcus radiodurans R1
  CDS (1)..(756): transl_table=11
gtggttcagacgcttagaatgcctccgatgcgctggcttccctccgttctcctgctcctcaccggtctgctgctcgcggccctcgcgctcggcgtgtttgccgtgctgggcggcagcggcccgctgtggctgcgttcgctcggcagcgtgacgctcggcggccctggcccgaacggcttcgcgcgcgggctggcgctgatgctgctggcaagcacgcgccctcgcgctggcgacgctgcgccgtccggaacccagatatttagaacccgagcccgcactggagcccgcgccgccgcagggctgaggtcgggccttaccatgtccctcatgacccctctgctgattcgggacgttctgaaggccctgccccaccgttatcccttcgtgctggtggaccgcgtgttcagcacggaaaatggcgaagtccatgcgctgaaaaacgtcaccatcaacgagccgtttttcatggggcactttcccaccgagcccgtcatgcccggcgtgctgattaccgaggcactggcgcaggcgagcatgttttgcctgcacgggcagatggaaccgggccagatcggctatctggcgggcatcgagggcgcccgcttcaagcgcaaggtgattcccggcgaccaactgcacctgcacgccaaactggaatttctgcgccggggcctgggcaaaaccacctgccgcgccgaggtagacggcgaagtggcggcggagatgcagattctgtttgcagtggcgaagggctga

SEQ ID NO: 146 - protein, 251 aa, Deinococcus radiodurans R1
MVQTLRMPPMRWLPSVLLLLTGLLLAALALGVFAVLGGSGPLWLRSLGSVTLGGPGPNGFARGLALMLLASTRPRAGDAAPSGTQIFRTRARTGARAAAGLRSGLTMSLMTPLLIRDVLKALPHRYPFVLVDRVFSTENGEVHALKNVTINEPFFMGHFPTEPVMPGVLITEALAQASMFCLHGQMEPGQIGYLAGIEGARFKRKVIPGDQLHLHAKLEFLRRGLGKTTCRAEVDGEVAAEMQILFAVAKG

SEQ ID NO: 147 - DNA, 663 bp, Arabidopsis thaliana; identical to SEQ ID NO: 133
  CDS (1)..(663)

SEQ ID NO: 148 - protein, 220 aa, Arabidopsis thaliana
MATTSNSVLFLSSDSLIHHHHHQPLHLSSSRSHSVSLPPNKRSNSLTLRCSTNGDSTSTEKETPIELKFPAFPTVMDINQIREILPHRFPFLLVDRVIEYTPGVSAVAIKNVTINDNFFPGHFPERPIMPGVLMIEAMAQVGGIVMLQPEVGGSQDNFFFAGIDKVRFRKPVIAGDTLVMRMTLLKFQKRFGLAKMEGKAYVGGALVCEGEFMMVSAGSS

SEQ ID NO: 149 - DNA, 492 bp, Pseudomonas putida KT2440
  CDS (1)..(492): transl_table=11
gtgtggtcagcacctgcgctccctattcttattacaggcttccccaccgaaatgatggacatcaacgagattcgcgaatacctgcctcaccgctacccgttcctgctggtagaccgtgtgacggatctggacttcgaggcccagagcattcgtgcctacaagaatgtcagcatcaatgagccgtttttcaatggccacttcccggcacacccgatcatgccgggtgtcctgatcatcgaagccatggcccaggcggccggcatccttggtttcaagatgctcgatgccaagccggccgatggcaccctgtactactttgtcggttccgacaaactgcgtttccgtcagccggttctgccgggtgaccagcttgtgctggaagccaagttcctcagccgtaaaagcatgatctggaagttcgagtgccgcgcccttgtcgatggcaagccggtctgctcggcagaaatcacctgcgcggaacgctccctatga

SEQ ID NO: 150 - protein, 163 aa, Pseudomonas putida KT2440
MWSAPALPILITGFPTEMMDINEIREYLPHRYPFLLVDRVTDLDFEAQSIRAYKNVSINEPFFNGHFPAHPIMPGVLIIEAMAQAAGILGFKMLDAKPADGTLYYFVGSDKLRFRQPVLPGDQLVLEAKFLSRKSMIWKFECRALVDGKPVCSAEITCAERSL

SEQ ID NO: 151 - DNA, 432 bp, Vibrio vulnificus CMCP6
  CDS (1)..(432): transl_table=11
atgaatatctctgaaattcaagagctacttcctcatcgctacccattcttgctgatcgaccgtgtcgtagatttccaagaagaaaaatatcttcatgcgattaaaaatgtgtcggttaacgagcctcagtttacaggtcatttcccgcaacttccggtcttccctggtgttctgattcttgaagccatggctcaggcaaccggtttattggcatttaaatcgtttggtgctccttctgagaacgaactgtattacttcgccagtgtggatggtgctaagttccgtaaaccagttgtacccggtgaccaacttatcatcgaagtcgaattcattaaagagcgtcgcggtattgccgctttcaccggtgtggcaaaagtggatggtgacgttgtttgttctgctgaactgaaatgtgctcgtagagagttttaa

SEQ ID NO: 152 - protein, 143 aa, Vibrio vulnificus CMCP6
MNISEIQELLPHRYPFLLIDRVVDFQEEKYLHAIKNVSVNEPQFTGHFPQLPVFPGVLILEAMAQATGLLAFKSFGAPSENELYYFASVDGAKFRKPVVPGDQLIIEVEFIKERRGIAAFTGVAKVDGDVVCSAELKCARREF

SEQ ID NO: 153 - DNA, 504 bp, Bordetella parapertussis 12822
  CDS (1)..(504): transl_table=11
ttggcggcgcattgcaacataatctatttttgctttgcaggaaaacaaatggaactcgacatcaaggggatcatggaccggctgccgcatcgctacccgatgctgctgatcgaccgtgtgctggagatggtgcccggcaaatccatcgttgccatcaagaacgtctcgatcaacgagccgtttttcacgggccattttccgcatcatccggtcatgccgggcgtgctgatcgtcgaggccatggcgcaggcttcggccctgttctcgttcaccgacgagaacggcgggctgaagtgcgacggcgccaagaccgcctactacctggtgggcatcgacggcgcgcggttccgtaaacccgtggtgccgggcgaccagttgcggctggaagtcgaggccgagcgcctgtcgtgtaccatctgcaagtaccagggccgggccctggtcgacggccaactggtcgccgaagccaagctgatgtgcgcgatccgtagcctggaagagtaa

SEQ ID NO: 154 - protein, 167 aa, Bordetella parapertussis 12822
MAAHCNIIYFCFAGKQMELDIKGIMDRLPHRYPMLLIDRVLEMVPGKSIVAIKNVSINEPFFTGHFPHHPVMPGVLIVEAMAQASALFSFTDENGGLKCDGAKTAYYLVGIDGARFRKPVVPGDQLRLEVEAERLSCTICKYQGRALVDGQLVAEAKLMCAIRSLEE

SEQ ID NO: 155 - DNA, 489 bp, Acinetobacter sp. ADP1
  CDS (1)..(489): transl_table=11
atgatgactgagtcaaacactcctgcgtttacgatccctgaattgccaatggacattcaaaaaattcgtgaatatttgccacatcgctatccattcctattggttgatcgtgtagttgaagttggtgaaaataatattgttggctataaaaacgtttcgattaacgaagagttttttcagggccattttcctgattatccgattatgccaggtgtcttgattgtagaggctttggcacaaatttctggtattttgggttttattatgaataatgaaactcctaaaccaggttctttgtttctgttcgcaggggctgagaaagttcgtttcaaaaaacaagtggttgctggtgatcagctcgttttaaaagctgaacttgtcatgcaaaaacgtggtatctacaaatacaattgtactgctacggttgatggtaaagtcgctacaaccgctgaaattatagtttcgcatttaagaacagagcaggcatga

SEQ ID NO: 156 - protein, 162 aa, Acinetobacter sp. ADP1
MMTESNTPAFTIPELPMDIQKIREYLPHRYPFLLVDRVVEVGENNIVGYKNVSINEEFFQGHFPDYPIMPGVLIVEALAQISGILGFIMNNETPKPGSLFLFAGAEKVRFKKQVVAGDQLVLKAELVMQKRGIYKYNCTATVDGKVATTAEIIVSHLRTEQA

SEQ ID NO: 157 - DNA, 510 bp, Burkholderia pseudomallei K96243
  CDS (1)..(510): transl_table=11
ttgcagtcatcaccgcgcagccattgcgtgagacgaaccatcatgagcactgaaaaaatcaacttcgacattcacaagatcctcacgctgctgccgcaccgctatccgattctgctcgtcgatcgcgtgctcgaactcgaaccgcacaaggccatcaaggcgctgaagaacgtgacggtcaacgagccgttcttcaccggccactttccgaagcggccggtgatgccgggcgtgctgatcatcgaggcgctcgcgcaggcggccgcgctcctcacgttcgccgaggcgcagccgaaggatccggagaacacgctgtattacttcgtcggcatcgacaacgcgcgcttcaagcgcgtcgtcgagccgggcgaccagttgatcctgaacgtgacgttcgagcgctatattcgcggcatctggaagttcaaggccgttgcggaagtggacggcaaggtcgcggcggaagccgagctgatgtgcacggtcaagacggccgacgcggcgccctga

SEQ ID NO: 158 - protein, 169 aa, Burkholderia pseudomallei K96243
MQSSPRSHCVRRTIMSTEKINFDIHKILTLLPHRYPILLVDRVLELEPHKAIKALKNVTVNEPFFTGHFPKRPVMPGVLIIEALAQAAALLTFAEAQPKDPENTLYYFVGIDNARFKRVVEPGDQLILNVTFERYIRGIWKFKAVAEVDGKVAAEAELMCTVKTADAAP

SEQ ID NO: 159 - DNA, 516 bp, Anabaena variabilis ATCC 29413
  CDS (1)..(516): transl_table=11
atgtcaaccctctctgaagtgaaagcacccacatctacagaacaacccgccactaatgaggcgacgacaccacccgaaattaaaacgacttttacatctgaagaaattcagaaattattaccccaccgctacccattcttgctggtagacaaaattattgactacacaccaggaaaacaggcagtaggtattaaaaatgtcactattaacgagccacatttcactggccatttcccagatagaccactgatgccaggggtgctaatagttgaagcaatggcccaagtaggtggtattgtgatgacgcaactaccaaacttggaaggtggtttatttgtattcgcgggtatcgataaagtccgcttccgccgtcaagtcgtaccaggagaccaactggtaatgacagtggaactgttatggattaaacaacgtcgtttcggtaaaatgcaagcccgtgccgaagttgacggtcaactagcagctgaaggcgaattaatgttttcgctgatcaactaa

SEQ ID NO: 160 - protein, 171 aa, Anabaena variabilis ATCC 29413
MSTLSEVKAPTSTEQPATNEATTPPEIKTTFTSEEIQKLLPHRYPFLLVDKIIDYTPGKQAVGIKNVTINEPHFTGHFPDRPLMPGVLIVEAMAQVGGIVMTQLPNLEGGLFVFAGIDKVRFRRQVVPGDQLVMTVELLWIKQRRFGKMQARAEVDGQLAAEGELMFSLIN

SEQ ID NO: 161 - DNA, 462 bp, Methylobacillus flagellatus KT
  CDS (1)..(462): transl_table=11
atgactgaacaagctattacgagcatggatattcatgaaatactgaattacctgccacaccgatatccttttgtattggtggatcgtgtgctttccctggaattgaataaagagatcgtggctgtcaagaatgtcaccatcaacgaaccttttttcccggggcattttccttaccacccagtcatgccaggtgtattgatcgtggaggcactggcgcaggctgctgccatcctgtcgttcaagaccatggggaccaagcccaatgacaaatccgtgtactattttgccggcatggacaatgtccgcttcaagaagccggtgtcgccgggcgaccagctcattctcaaggtcagcatagaccgtatattgcgcggaatatggagatataagggagaagcactggtggacggtgcagtcgtggctgaagcagaaatgatgtgtatcctgaaggcgattgattga

SEQ ID NO: 162 - protein, 153 aa, Methylobacillus flagellatus KT
MTEQAITSMDIHEILNYLPHRYPFVLVDRVLSLELNKEIVAVKNVTINEPFFPGHFPYHPVMPGVLIVEALAQAAAILSFKTMGTKPNDKSVYYFAGMDNVRFKKPVSPGDQLILKVSIDRILRGIWRYKGEALVDGAVVAEAEMMCILKAID

SEQ ID NO: 163 - DNA, 468 bp, Burkholderia xenovorans LB400
  CDS (1)..(468): transl_table=11
atgagcaccgaaaaaatcaatctcgacattcacaagattctcacgctgctgccgcatcgttatccgattctgctcgtcgatcgggtgctcgaactcgagccgcacaagcgcatcaaggcgctgaagaacgtgtcgatcaacgagccgtacttcatgggtcactttccgagccgtcccgtgatgccgggcgtgctgattctcgaagcgctcgcgcaggccgcggcgctgctgacgttctcggaagaaccgcacgatcccggcaacacgctgtacctgttcgtcggcatcgacaatgcgcgcttcaaacgcgtagtcgagccgggcgaccagctgatcctgaacgcaacgttcgagcggcatatgcgcggcatctggaagttcagggcgtgcgcggaagtggataatgtggttgcggcgtcagcggatctgatctgcaccgtgcgcaacactgatgcggacgcacggtag

SEQ ID NO: 164 - protein, 155 aa, Burkholderia xenovorans LB400
MSTEKINLDIHKILTLLPHRYPILLVDRVLELEPHKRIKALKNVSINEPYFMGHFPSRPVMPGVLILEALAQAAALLTFSEEPHDPGNTLYLFVGIDNARFKRVVEPGDQLILNATFERHMRGIWKFRACAEVDNVVAASADLICTVRNTDADAR

SEQ ID NO: 165 - DNA, 465 bp, Burkholderia xenovorans LB400
  CDS (1)..(465): transl_table=11
atgagcaccgaaaaaatcaatctcgacattcataagattctcacgctgctgccacatcgttacccgatcctgctggtggaccgggtgctcgaactcgagccgcacaagaacatcaaagcgttgaagaacgtgtcgatcaacgaaccgtatttccagggccactttccgacccgtccggtcatgccgggcgtgctgattctcgaagcgctcgcgcaaacggcggctttgctgacgttttcggaagagccgagcgacccgtcgaacacgctgtatctgttcgtcggcatcgacaatgcacgcttcaagcgcgtggtggaaccgggcgatcagctgatcctgaactgcacgttcgagcgtcatatgcgcggcatctggaagttcaaggcgcgcgccgaagtggatggcgtagtagcggcggaagccgacctgatgtgcgcggtgcggcacacggacaaggacgcttga

SEQ ID NO: 166 - protein, 154 aa, Burkholderia xenovorans LB400
MSTEKINLDIHKILTLLPHRYPILLVDRVLELEPHKNIKALKNVSINEPYFQGHFPTRPVMPGVLILEALAQTAALLTFSEEPSDPSNTLYLFVGIDNARFKRVVEPGDQLILNCTFERHMRGIWKFKARAEVDGVVAAEADLMCAVRHTDKDA

SEQ ID NO: 167 - DNA, 453 bp, Ralstonia metallidurans CH34
  CDS (1)..(453): transl_table=11
atgaccgcatccgaaatcgatatccgcaagatcctgaagctgctgccgcatcggtatccgatcctgctggtcgaccgtgtgctcgagttcgaaccgcagaagcggatcaagacgctgaagaacgtgacgatcaacgagccgtacttcatgggccacttcccggaccaaccggtgatgccgggcgtcatgatcctcgaggcactggctcagtccgccggtcttctgacgttcggcgccgatatggagcgcaaggaaggtgcgttgtattacttcgtcgggatcgacggcgcgcgcttcaagcgcgtggtgtatccgggcgatcagcttcacctgaacgtgaccgtggagcgctatatccgcggaatctggaagttcaaggccagcgcgaccgtggacggtgaggtggcctgcgaggccgaactgatgtgcaccgtgaagcaagccgaaggctaa

SEQ ID NO: 168 - protein, 150 aa, Ralstonia metallidurans CH34
MTASEIDIRKILKLLPHRYPILLVDRVLEFEPQKRIKTLKNVTINEPYFMGHFPDQPVMPGVMILEALAQSAGLLTFGADMERKEGALYYFVGIDGARFKRVVYPGDQLHLNVTVERYIRGIWKFKASATVDGEVACEAELMCTVKQAEG

SEQ ID NO: 169 - DNA, 462 bp, Myxococcus xanthus DK 1622
  CDS (1)..(462): transl_table=11
atggacatcggagagattctcaatctgctgccgcatcggtacccgttcctgctggtggaccgggtggtggagatcatcccgggccagaagctgacggcctacaagaacgtcaccatcaacgagcccttcttcaacgggcacttccccggtcacccggtgatgccgggtgtgctcatcctggaggcgctggcgcaggcgacggccatcctcgcctacaagagcgagaacatggatccgtcgcgcaagctcacgtacctgatgggcgtggacggcgcgcgcttccgcaagccggtgttgccgggggatcgcctccagttggagatcgaggtggtgcgtcacaagggcgctgtctggaagacgaagggcctggcgacggtcgacggcgcgcgtgtcgccgaaggcgagttcctggcaaccgtcgtggacaaggacgccgacgcggctgagagcgcggcatcctga

SEQ ID NO: 170 - protein, 153 aa, Myxococcus xanthus DK 1622
MDIGEILNLLPHRYPFLLVDRVVEIIPGQKLTAYKNVTINEPFFNGHFPGHPVMPGVLILEALAQATAILAYKSENMDPSRKLTYLMGVDGARFRKPVLPGDRLQLEIEVVRHKGAVWKTKGLATVDGARVAEGEFLATVVDKDADAAESAAS

SEQ ID NO: 171 - DNA, 453 bp, Rubrobacter xylanophilus DSM 9941
  CDS (1)..(453): transl_table=11
atgagggcgccgctcgggccggccgagatccggcgtctcctcccgcaccgctacccctttctgctggtcgacaggatcgaagagctcgagcccggcgtcagggcggtgggcgtaaagaacgtcacccagaacgagcccttcttccagggacacttcccgggctacccggtgatgccgggcgtactcatcgtggaggccatggcccaggtgggggccgtgggggtcatggccgtggaggagtaccgcggcaggctcgcgctcttcgccggcatagacggcgtccgcttcaggaggcaggtcgtgcccggcgacgcgctccggatggaggtcgagatagaccggctcaggggccgcgtcgggcgcggccgggggctggccttcgtgggcggggagcgggcctgcgaggcggagctcatgttcgcgttcgccgagaggggggaggagagccgatga

SEQ ID NO: 172 - protein, 150 aa, Rubrobacter xylanophilus DSM 9941
MRAPLGPAEIRRLLPHRYPFLLVDRIEELEPGVRAVGVKNVTQNEPFFQGHFPGYPVMPGVLIVEAMAQVGAVGVMAVEEYRGRLALFAGIDGVRFRRQVVPGDALRMEVEIDRLRGRVGRGRGLAFVGGERACEAELMFAFAERGEESR

SEQ ID NO: 173 - DNA, 456 bp, Haemophilus somnus 129PT
  CDS (1)..(456): transl_table=11
atgactgtgacaactgaacgtattgcaagaataattgaatcaaaagaaattatgacacttctccctcatcgctatccgtttttattggtagatcgtgtaactgattatgaagaagggaaatggttaaccgcaattaaaaatgtgagtgtaaatgaaccttgttttacaggtcatttccctgatcaacctattttgccgggggtattaattttagaagcattagcacaagcaatggggattttggcgttcaaaactcacgagttaagtaataaagagctattttattttgctggtgtggatgaggcacgttttaaacgtcctattttaccgggagatcaaatgatgttaaaagttgaagtcattagggaacgccgtggtattaccgcttttacaggtgtggcgagtgtaaatggtgaagtagcttgtgaagccaaattaatgtgtgctcgtagataa

SEQ ID NO: 174 - protein, 151 aa, Haemophilus somnus 129PT
MTVTTERIARIIESKEIMTLLPHRYPFLLVDRVTDYEEGKWLTAIKNVSVNEPCFTGHFPDQPILPGVLILEALAQAMGILAFKTHELSNKELFYFAGVDEARFKRPILPGDQMMLKVEVIRERRGITAFTGVASVNGEVACEAKLMCARR

SEQ ID NO: 175 - DNA, 465 bp, Synechococcus sp. CC9311
  CDS (1)..(465): transl_table=11
ttgaccgttcttgcctctaacgaccctccaacagcggtgctgaatgccgagcagatcatgggtttgctgccgcatcgttatccatttgccttggtggatcgtgtgctggagcacgttccaggcgaacgcgctgttgcgctcaagaacgtcacctttaatgagccacagttccagggacatttccctggtcgacctctgatgccaggggttttgattgtggaagcgatggctcaggtgggtgggttgattgtgactcagatgccagatctcccaaagggcctgttcgtgttcgccggaattgatggagttcgttttcgtcggccggtggttccaggggatcagttaaggattacgtgcgagttgctcagcctgaaacgcaagcgttttggcaaagtgaaagcggaggccacggtggatggacagcttgtctgttccggtgagctgatgttttctctggtggattga

SEQ ID NO: 176 - protein, 154 aa, Synechococcus sp. CC9311
MTVLASNDPPTAVLNAEQIMGLLPHRYPFALVDRVLEHVPGERAVALKNVTFNEPQFQGHFPGRPLMPGVLIVEAMAQVGGLIVTQMPDLPKGLFVFAGIDGVRFRRPVVPGDQLRITCELLSLKRKRFGKVKAEATVDGQLVCSGELMFSLVD

SEQ ID NO: 177 - DNA, 465 bp, Shewanella sp. MR-4
  CDS (1)..(465): transl_table=11
gtgtcaaatcaaatgaacactatggatattacggagatccttaagtatctgccccatagatatccatttttattaatcgatcgcgttttggattacaccccaggtgagagtctccatgcgattaaaaacgtgacgattaatgaaccctttttccagggacatttccctgttcagcctgtgatgcctggcgtgctgattttagaagctatggcacaggccactggtctgctcgcatttaagaccatgagtgacgatgtaccacctcctggtgtgttgtactattttgccggtatcgataacgcgcgttttagacgtgtggttgagcctggcgatcaaatccattttgacgtcaaaatgattaaagagcgccgcggaattggcgttttctatggtgaggccaaagtggatggtgaagtggtttgttccgctgaaatcatgtgtgcccgcagagagattaatcagtga

SEQ ID NO: 178 - protein, 154 aa, Shewanella sp. MR-4
MSNQMNTMDITEILKYLPHRYPFLLIDRVLDYTPGESLHAIKNVTINEPFFQGHFPVQPVMPGVLILEAMAQATGLLAFKTMSDDVPPPGVLYYFAGIDNARFRRVVEPGDQIHFDVKMIKERRGIGVFYGEAKVDGEVVCSAEIMCARREINQ

SEQ ID NO: 179 - DNA, 468 bp, Alkalilimnicola ehrlichei MLHE-1
  CDS (1)..(468): transl_table=11
ttgaacgcatcgacggaaacctctatcgccctgccggatatcaatgacatcatgcggaacctgccacaccgctatcctatgctgctgatcgaccgggtggtggcgttcagcaagcgggaacggctggtggggatcaagaatgtcaccatcaacgagccctatttcgccggccactttccccagaaaccggtgatgcccggggtgcttatcctggagtcgatggcccaggcctgtggcatgcttgccttcaagagcgaacaggaggaactcgggggtaaccacattatctatctggtggcgatcgacaaggcgcggtttaaacgcccggtggagcccggcgatcaactccgcctggaggccagcctcaagcgggtgatgcgggggctgtggatgttccaggcccaggcctgggtgggtgatgccctggcggccgaggccgagattcgctgcacggtgaaagaggcgtga

SEQ ID NO: 180 - protein, 155 aa, Alkalilimnicola ehrlichei MLHE-1
MNASTETSIALPDINDIMRNLPHRYPMLLIDRVVAFSKRERLVGIKNVTINEPYFAGHFPQKPVMPGVLILESMAQACGMLAFKSEQEELGGNHIIYLVAIDKARFKRPVEPGDQLRLEASLKRVMRGLWMFQAQAWVGDALAAEAEIRCTVKEA

SEQ ID NO: 181 - DNA, 468 bp, Rhizobium leguminosarum bv. viciae 3841
  CDS (1)..(468): transl_table=11
atgactgaggaagccacgacaacgctttcttcggctgacatcatcgagatcatgaaactgctgccacatcgttacccgtttctcatggtcgacaagatcatcgagatcgacggcgacaacacggcgatcggcatcaagaacgtcacagtgaacgaaccgcatttcaccggccattttccggaatctccgatcatgccaggcgttctcttgatcgagggcatggctcagaccgcgggtgcgatctgtgccaagaaggatggccagccaggcaacctcgtctatttcatgaccatcgagaatgcgcgcttccgcaagcccgtcgtgcccggcgatcgtgttgaattccatgtcaggaagcacaagcagcgcggcaatatctggaaattccattgcgatgccaaggttgacggcgcgcttgtcgccgaagccgatatcggcgcgatgatcgttcgtaaggatcaggcatga

SEQ ID NO: 182 - protein, 155 aa, Rhizobium leguminosarum bv. viciae 3841
MTEEATTTLSSADIIEIMKLLPHRYPFLMVDKIIEIDGDNTAIGIKNVTVNEPHFTGHFPESPIMPGVLLIEGMAQTAGAICAKKDGQPGNLVYFMTIENARFRKPVVPGDRVEFHVRKHKQRGNIWKFHCDAKVDGALVAEADIGAMIVRKDQA

SEQ ID NO: 183 - DNA, 462 bp, Magnetococcus sp. MC-1
  CDS (1)..(462): transl_table=11
atgtctacagatcccatctccttgcaggaaatcatgtcgtttctgccccatcgctacccttttttgctgattgaccgtattgtcgaagtggagcagggtaagcgaattttggccattaaaaatgtgtccttcaatgaaccccattttcagggccattttccagaccatccggtcatgcctggtgtgttgattctggaagccatggctcaggccggtgcgctgttagcgggctatactgatcccgactctgtgcgcggtcaattggtctattttatggccatcgacaaagcccgtttccgcaaacccgttttaccgggtcatcaactgaatattgagatgaccctgctcaaacggcgccgcgaggtttggcgctttggggggaaagcgatggttgacggagaggtcgcttgtgaggccgaggtgatggcaatgacgcgaaagagagaagagagccatgagtga

SEQ ID NO: 184 - protein, 153 aa, Magnetococcus sp. MC-1
MSTDPISLQEIMSFLPHRYPFLLIDRIVEVEQGKRILAIKNVSFNEPHFQGHFPDHPVMPGVLILEAMAQAGALLAGYTDPDSVRGQLVYFMAIDKARFRKPVLPGHQLNIEMTLLKRRREVWRFGGKAMVDGEVACEAEVMAMTRKREESHE

SEQ ID NO: 185 - DNA, 453 bp, Shewanella sp. ANA-3
  CDS (1)..(453): transl_table=11
atgaacactatggatattacggagatccttaagtatctaccccatagatatccatttttattaatcgatcgcgttttagattacaccccaggtgagagtctccatgcgattaaaaacgtgacgattaatgaaccctttttccagggacatttccctgttcagcctgtgatgcccggcgtgctgattttagaagctatggcgcaggccactggtctgctcgcgtttaagaccatgagtgacgatgtaccgcctcctggtgtgttgtactattttgctggtatcgataacgcgcgttttagacgtgtggttgagcccggcgatcaaatccattttgaagtcaaaatgattaaagagcgccgcgggattggcgttttctatggtgaggccaaagtggatggtgaagtggtttgttccgctgaaatcatgtgtgcccgcagagagattaatcagtga

SEQ ID NO: 186 - protein, 150 aa, Shewanella sp. ANA-3
MNTMDITEILKYLPHRYPFLLIDRVLDYTPGESLHAIKNVTINEPFFQGHFPVQPVMPGVLILEAMAQATGLLAFKTMSDDVPPPGVLYYFAGIDNARFRRVVEPGDQIHFEVKMIKERRGIGVFYGEAKVDGEVVCSAEIMCARREINQ

SEQ ID NO: 187 - DNA, 438 bp, Azoarcus sp. BH72
  CDS (1)..(438): transl_table=11
atggatatcaacgaaatcgtccaatacctcccacaccgttaccccttcctgctggtggatcgggtgctggagctggaagagaacaagcgcatcctcgcgctgaagaacgtgacgatgaacgaaccgttcttcccgggccatttcccgcatcacccggtgatgcccggcgtcctcatcgtcgaggcaatggctcaggccgccgcggtgctgtcgttcaagagcatgggcgtgaagcccgaccagaattcggtcgtttacttcgcgggcatcgacgccgtgcgcttcaagcgcccggtggtaccgggggaccagttgctgatggaagtcgagatcacccagagcaagcgcaacatctacaagtacaagggcgtagcgcgcgtgaatggtgaaatcgcgaccgaagccgaactgatgtgcgcactcaagaccctgtcatga

SEQ ID NO: 188 - protein, 145 aa, Azoarcus sp. BH72
MDINEIVQYLPHRYPFLLVDRVLELEENKRILALKNVTMNEPFFPGHFPHHPVMPGVLIVEAMAQAAAVLSFKSMGVKPDQNSVVYFAGIDAVRFKRPVVPGDQLLMEVEITQSKRNIYKYKGVARVNGEIATEAELMCALKTLS

SEQ ID NO: 189 - DNA, 531 bp, Nostoc punctiforme PCC 73102
  CDS (1)..(531): transl_table=11
atgtcaatcctcactgaagtgaatactatcgatccaactacacctacatctaccgaactacagggtataaatgagactgcgatcgcctctgaaattaaaacaactttcacatctgaagaaattcaaaaattattaccccaccgctacccatttttacttgtagataaaataattgactacgttccaggtaaaaaagctgttggcgttaaaaatgttactatcaacgaacactatttccaaggacatttccccggccgtccactgatgccaggggtgctaattgtcgaagcaatggcacaagttgggggcattgttcttactcaaatgtcttcggtagaaggcgggctatttgttttcgctggtatcgataaagttcgctttcgccgccaggtcgtaccgggggatcaactagtcatgacagtggaactgttatgggtaaaacaacgtcgtttcggtaagatgcaaggtcgtgccgaagttgacggtcaacttgcttgtgaaggggaattaatgttttctctagtcaactaa

SEQ ID NO: 190 - protein, 176 aa, Nostoc punctiforme PCC 73102
MSILTEVNTIDPTTPTSTELQGINETAIASEIKTTFTSEEIQKLLPHRYPFLLVDKIIDYVPGKKAVGVKNVTINEHYFQGHFPGRPLMPGVLIVEAMAQVGGIVLTQMSSVEGGLFVFAGIDKVRFRRQVVPGDQLVMTVELLWVKQRRFGKMQGRAEVDGQLACEGELMFSLVN

SEQ ID NO: 191 - DNA, 465 bp, Actinobacillus pleuropneumoniae serovar 1 str. 4074
  CDS (1)..(465): transl_table=11
atgactattgaagtacaagaaaatagagaacctaaaattattgaagtaacggaaattatgaaaatgttacctcatcgctatcctttcttacttgtagatcgtgttattgattttgaagaaggcaaatggctgaaagcaattaaaaacgtgaccgtaaacgaaccttgttttaccggtcacttccctgaaagtccgattttccctggcgtacttattttagaagcgatggcgcaagcaaccggcgtattagcggtcgcgacacacggaaaaatggcgcaagacgaattatattattttgcggctattgataatgctcgctttaagcgtccggtcgtgccgggtgaccaacttacattcgaagttgaatttttaaaagaaatgcgtggtatcactaaatttaccggaaaagcttttgttgatggaaaactagtgtgcgaagccgatttaatgtgtgcacgtaaataa

SEQ ID NO: 192 - protein, 154 aa, Actinobacillus pleuropneumoniae serovar 1 str. 4074
MTIEVQENREPKIIEVTEIMKMLPHRYPFLLVDRVIDFEEGKWLKAIKNVTVNEPCFTGHFPESPIFPGVLILEAMAQATGVLAVATHGKMAQDELYYFAAIDNARFKRPVVPGDQLTFEVEFLKEMRGITKFTGKAFVDGKLVCEADLMCARK

SEQ ID NO: 193 - DNA, 441 bp, Listeria monocytogenes str. 4b H7858
  CDS (1)..(441): transl_table=11
atgtatatgttagatattaagaaaatcaaagagattttgcctcatcgttatccatttttgttagtagatagagttatttctgttgaagaaggcaaaaaagttaccgctattaagaatgtaacagcaaatgaagaattttttaacgggcactttcctgagtatcctgtaatgccaggagttttaatagtggaagctctagcgcaaactagtggaattgcaatgatgcagagtgaagcaaataaaggtaaaattggtttatttgctggaattgatggttgccgatttaaacgtcaagttgttccgggggaccaactcttgcttgaggctgaaataactcggatgaggggcgcgattgcaaaagcaaaagtcaaagcaactgtagaaggcgatttggtttgtgaagctgaaattatgtttgccttatcagacctacctaaataa

SEQ ID NO: 194 - protein, 146 aa, Listeria monocytogenes str. 4b H7858
MYMLDIKKIKEILPHRYPFLLVDRVISVEEGKKVTAIKNVTANEEFFNGHFPEYPVMPGVLIVEALAQTSGIAMMQSEANKGKIGLFAGIDGCRFKRQVVPGDQLLLEAEITRMRGAIAKAKVKATVEGDLVCEAEIMFALSDLPK

SEQ ID NO: 195 - DNA, 438 bp, Rubrivivax gelatinosus PM1
  CDS (1)..(438): transl_table=11
atggacattcaccagatcctcgagaaactgccgcatcgctatccgttcctgctggtggaccgggtgctggaggtcgaggccggcgtgcgcatcaaggcgctgaagaacgtcacgatcaacgagccgttcttcgtcgggcactttccgcaccggccggtgatgccgggcgtgctgatgctggaggcgctggcgcaggccgccgcgttgctgagctttgccgacaacaacctgcagtccgacaagaactcggtgatctatttcgtcggcatcgacggtgcgcgcttcaagcggcctgtggagcccggcgaccagctgatcctcgaggtcgaggccgatcgcgtccgcggcggcatccacaagttcaaggcacgcgccacggtcgccggggaactggcctgcggtgccgagctgatgtgcacgatgcgcagcgtcgcctga

SEQ ID NO: 196 - protein, 145 aa, Rubrivivax gelatinosus PM1
MDIHQILEKLPHRYPFLLVDRVLEVEAGVRIKALKNVTINEPFFVGHFPHRPVMPGVLMLEALAQAAALLSFADNNLQSDKNSVIYFVGIDGARFKRPVEPGDQLILEVEADRVRGGIHKFKARATVAGELACGAELMCTMRSVA

SEQ ID NO: 197 - DNA, 456 bp, Prochlorococcus marinus str. MIT 9211
  CDS (1)..(456): transl_table=11
ttgactaactctccttctaatgatgtttttttaaccagtgaggcaatcatgggtctccttccccataggtatccatttgctctggttgatcgagttattgattatcaacccggtaaaagcgcagttgcgataaagaatgtcacagttaacgaaccgcaatttcaaggacatttccctggaaggccattaatgccaggtgttttgattgttgaggcgatggctcaagtaggaggattaattgttactcagatgccagatttaccaaaagggctttttgtttttgcgggtatagatggagttcgttttcgaaggccagtggtgcctggagatcaactgactattggttgtgaattaatcagtattaaaagacaacgttttggcaaagttaagggagaagccaaagtagatggacagttggtttgctctggtgaattgatgttttctctagttgattga

SEQ ID NO: 198 - protein, 151 aa, Prochlorococcus marinus str. MIT 9211
MTNSPSNDVFLTSEAIMGLLPHRYPFALVDRVIDYQPGKSAVAIKNVTVNEPQFQGHFPGRPLMPGVLIVEAMAQVGGLIVTQMPDLPKGLFVFAGIDGVRFRRPVVPGDQLTIGCELISIKRQRFGKVKGEAKVDGQLVCSGELMFSLVD

SEQ ID NO: 199 - DNA, 468 bp, Synechococcus sp. RS9917
  CDS (1)..(468): transl_table=11
ttgaccacccccccctccacggccacgcccaccgagcctgtgctcacgagtgagcagatcatgggcttgttgccccatcgctatcccttcgccctagtcgatcgggttctggagcatgagccgggagtgcgggcagtggccatcaagaatgtgaccctgaacgagccgcagtttcagggtcatttccccgatcgtcccttgatgcccggggtgctgatcgtggaggcgatggcccaggtgggcggactgatcgtcacccagatgcccgacctccccaagggactgttcgtgtttgcaggcattgatggagtccgttttcggcgacctgtggtgcccggcgatcagctgcgaatctgctgcgagctgctcagtctgaagcggcagcgcttcggcaaagtgaaagcggaagcctcggtggagggtcagctcgtctgctccggtgagctgatgttctccctggtggactga

SEQ ID NO: 200 - protein, 155 aa, Synechococcus sp. RS9917
MTTPPSTATPTEPVLTSEQIMGLLPHRYPFALVDRVLEHEPGVRAVAIKNVTLNEPQFQGHFPDRPLMPGVLIVEAMAQVGGLIVTQMPDLPKGLFVFAGIDGVRFRRPVVPGDQLRICCELLSLKRQRFGKVKAEASVEGQLVCSGELMFSLVD

SEQ ID NO: 201 - DNA, 456 bp, Synechococcus sp. WH 5701
  CDS (1)..(456): transl_table=11
ttgtccgttcctcccgctggcgcccccctgctcacctccgagcagatcctcaacctgctgccccaccgttatcccttcgcgctcgtggatcgggtgatcgagtacgaaccgggcaaacgggccgttgccctcaagaacgtcaccctcaatgagccccagttccagggccatttccctggccgccccttgatgcccggagtgctgatcgtggaggccatggcccaggtgggtggtctgatcgtcacccagatgccggagttgcccaaggggttgttcgtgttcgccggcatcgacggggtgcgtttccgccggccggtggtgcccggtgatcagttgcgcatcagctgcgaactgctcagtctcaaacgcaagcggttcggcaaagtgaaggctgaagtcaccgtcgacggagacctggtctgctcaggggaactcatgttctccctggttgactga

SEQ ID NO: 202 - protein, 151 aa, Synechococcus sp. WH 5701
MSVPPAGAPLLTSEQILNLLPHRYPFALVDRVIEYEPGKRAVALKNVTLNEPQFQGHFPGRPLMPGVLIVEAMAQVGGLIVTQMPELPKGLFVFAGIDGVRFRRPVVPGDQLRISCELLSLKRKRFGKVKAEVTVDGDLVCSGELMFSLVD

SEQ ID NO: 203 - DNA, 471 bp, Synechococcus sp. WH 7805
  CDS (1)..(471): transl_table=11
ttgacctcttcctccgccaacgacgttgtgacgtcccagcccgtgctcaatgcggagcagatcatgggtctgttgccgcaccgctacccctttgccctggtcgatcgggtgctcgagcatgttccaggtgaaaaggccgtggccatcaaaaatgtgactctgaatgagccccagtttcaagggcattttccggcacgaccgctaatgcctggcgtgctgatcgtggaggcgatggctcaggtgggcggcctgatcgtgacccagatgcccgatctccccaagggactgttcgtgtttgccggcatcgacggcgtgcgtttccgtcgcccggtggtccccggtgatcagctctgcatcagttgtgaactcctcagcctcaagcgcaagcgcttcggcaaggtgaaggcggaagccaccgtggatggtcagctggtttgttccggcgagttgatgttctcgctggtggattga

SEQ ID NO: 204 - protein, 156 aa, Synechococcus sp. WH 7805
MTSSSANDVVTSQPVLNAEQIMGLLPHRYPFALVDRVLEHVPGEKAVAIKNVTLNEPQFQGHFPARPLMPGVLIVEAMAQVGGLIVTQMPDLPKGLFVFAGIDGVRFRRPVVPGDQLCISCELLSLKRKRFGKVKAEATVDGQLVCSGELMFSLVD

SEQ ID NO: 205 - DNA, 453 bp, Pseudoalteromonas tunicata D2
  CDS (1)..(453): transl_table=11
ttggctaatgaattaaacagctttgatattctcgagattataaagttattaccccatcgctatcctatgctgttggttgataaagtggtggactacgaagctggtaaatcattacatgcaatcaagaatgtaacgattaacgaaccaatttttactgggcacttcccaaatcagcctattttccctggagttttaattttagaagcacttgcgcaagcaacgggtttgcttggctttaaaacagccgagaacaccagcgaaaatgaactatacttgtttgctgccattgataacgcccgctttaaaaagccggtatatcctggtgatacaatgcaccttcacgttgaatttgttaaagaacgtcgcaatatttggaagttttatggcgaagctaaagtagacggtgttgtggtgtgctctgctgaattaatgtgtgctagaagagagttttaa

SEQ ID NO: 206 - protein, 150 aa, Pseudoalteromonas tunicata D2
MANELNSFDILEIIKLLPHRYPMLLVDKVVDYEAGKSLHAIKNVTINEPIFTGHFPNQPIFPGVLILEALAQATGLLGFKTAENTSENELYLFAAIDNARFKKPVYPGDTMHLHVEFVKERRNIWKFYGEAKVDGVVVCSAELMCARREF

SEQ ID NO: 207 - DNA, 456 bp, Photobacterium sp. SKA34
  CDS (1)..(456): transl_table=11
ttgaccagcgaaaataagacgctaaacatcacagaaattcaggaactgcttcctcatcgttatcctttcttaatgattgaccgtgttactaattatgatgaaggcaaaacgttaacagcaatcaaaaatgtttctgtcaatgagcctcaatttactggtcatttccctaatatgccggtgtttccaggtgtaatgattttagaagcgatggcacaagcaacaggtctacttgcatttaaaacctttggtgcacctgctgaaaatgaactgtactactttgcaagtatcgataaagcaaagtttcgtaagcctgtaggccctggcgatcagcttattttgaatgttgaatttatcaaggagcgtcgcggtattgcgctatttaatggcgtagcaacagttgacggtgaagtggtatgttcagctgaacttaaatgtgcacgacgagtattctcatga

SEQ ID NO: 208 - protein, 151 aa, Photobacterium sp. SKA34
MTSENKTLNITEIQELLPHRYPFLMIDRVTNYDEGKTLTAIKNVSVNEPQFTGHFPNMPVFPGVMILEAMAQATGLLAFKTFGAPAENELYYFASIDKAKFRKPVGPGDQLILNVEFIKERRGIALFNGVATVDGEVVCSAELKCARRVFS

SEQ ID NO: 209 - DNA, 438 bp, Oceanospirillum sp. MED92
  CDS (1)..(438): transl_table=11
atgatggatgttaatgaaattcgggaatatctcccacaccgctatcctttcttacttgtggatagggtgctggagttagaaaagggagaatccattgtagccatcaaaaatgtaacggtgaatgaaccattttttaatggccacttcccagatcatccggttatgcctggcgtattaattgtcgaagctatggcgcaagcggctggcattctaggtttcaaaaccatggataagaagccacaagatggttctatctactactttgtgggttctgataagttgcgtttcaagcgtcctgtcgttcctggcgaccaacttaagctggaagcgaaagtgatttctgaacgtcgtggtatctggaaatttgacgtgcgtgcgtctgttgaaggtgatacggttagttctgcaactatcttgtgtgctgatagaaaggtttaa

SEQ ID NO: 210 - protein, 145 aa, Oceanospirillum sp. MED92
MMDVNEIREYLPHRYPFLLVDRVLELEKGESIVAIKNVTVNEPFFNGHFPDHPVMPGVLIVEAMAQAAGILGFKTMDKKPQDGSIYYFVGSDKLRFKRPVVPGDQLKLEAKVISERRGIWKFDVRASVEGDTVSSATILCADRKV

SEQ ID NO: 211 - DNA, 477 bp, marine gamma proteobacterium HTCC2207
  CDS (1)..(477): transl_table=11
atgaccgaaaacaatggcaccgacggcgccctgacagttacagaaattatgaatattttgccccaccgctatccctttttgctggtggacagagtgttggaactggttgagggtgagcggattctggcgatgaaaaatatcaccggtaatgaggatgttttcaacggtcattttcccggtgcgccgatctttcccggcgtgatgattattgaagccctggctcaggcctcgggtattcttggttttaaaacaaccaataccactgctgatgacggtaagctctatctgtttgccggtgttgacaaggctcgctttaaaaagccggtgacccccggtgatcagctgatgctggagtcccaagttgttgctgtgaagcgcaatatctggcgttttcaaacccgtgccacagtcaatgataagctcgtctgtgaagctacgttactctgtgcctatcaggatcgagataaagttaagtga

SEQ ID NO: 212 - protein, 158 aa, marine gamma proteobacterium HTCC2207
MTENNGTDGALTVTEIMNILPHRYPFLLVDRVLELVEGERILAMKNITGNEDVFNGHFPGAPIFPGVMIIEALAQASGILGFKTTNTTADDGKLYLFAGVDKARFKKPVTPGDQLMLESQVVAVKRNIWRFQTRATVNDKLVCEATLLCAYQDRDKVK

SEQ ID NO: 213 - DNA, 444 bp, Rickettsiella grylli
  CDS (1)..(444): transl_table=11
atgagcgatattatggatatccaagaaatactcacttatttaccccagcgctatcctattttaatgattgataaagtgataaaaatagtgccgggtaagtcgatagtggccttgaaaaatgtaaccgttaatgaaccttattttttaggtcatttcccgggtaatccgattatgcccggcgtacttattttagaaacaatggcacaagcgacaggtattcttgctttacatgcgaatagagaaaataaagaaggttttttatatctttttgcaggtattgatgaagcacgttttaaaaagcccgttgtaccaggggatcaattattaatagaagctgaagttctcaaagtaaagggtaatgtttggaaatgcaaagtcattgcaaaagtgggcaatgaattggcttgcgaagcaatcctcatgggtgccgggagaaaatgctga

SEQ ID NO: 214 - protein, 147 aa, Rickettsiella grylli
MSDIMDIQEILTYLPQRYPILMIDKVIKIVPGKSIVALKNVTVNEPYFLGHFPGNPIMPGVLILETMAQATGILALHANRENKEGFLYLFAGIDEARFKKPVVPGDQLLIEAEVLKVKGNVWKCKVIAKVGNELACEAILMGAGRKC

SEQ ID NO: 215 - DNA, 450 bp, Oceanobacter sp. RED65
  CDS (1)..(450): transl_table=11
atgacgaccatggactatcagcgaatcactgatctgttgccccatcgttatccgtttctgttggttgatcgtgtaactgagttagagaccaagcaacgtattgttggatacaaaaacgtgagtagtaatgagcctttttttcaaggccatttccccaagcatccgattatgcctggagtattaattttagagtctctcgcgcaattggctggcctgttggggttagatgcgattgatcgagaaaaagcagaaaatacggtttattattttgccggagtggatacagctcgttttaagaaaccagtgatacccggcgatcgtctagatatggaagcccgttatgtgaacgacaaacggggaatctggcgctttgaatgtgaagccaaggtcgatggaaagctggcctgtcaggctgaaatcctgtgtgcagaaagggaaataaagttgtga

SEQ ID NO: 216 - protein, 149 aa, Oceanobacter sp. RED65
MTTMDYQRITDLLPHRYPFLLVDRVTELETKQRIVGYKNVSSNEPFFQGHFPKHPIMPGVLILESLAQLAGLLGLDAIDREKAENTVYYFAGVDTARFKKPVIPGDRLDMEARYVNDKRGIWRFECEAKVDGKLACQAEILCAEREIKL

SEQ ID NO: 217 - DNA, 441 bp, Acidovorax sp. JS42
  CDS (1)..(441): transl_table=11
atgatggatatccaccaaattctcaaactcctgccccaccgctatccgttcctgctggtggatcgggtgaatgagctcgaacgcggcaagcgcatcctggccatcaagaacgtgaccatcaacgagccgtttttcacggggcacttccccgcacgcccggtgatgccgggggtgttgattctcgaagcactcgcgcaggcggcgggcttgctgtcgttcgacatgatgggtgaggcgccgggcgacgacaaggtcttttacttcgtcggtatcgatggtgcgcgcttcaagcgccccgtggagccaggcgatcagctcatcctcgacgtggaactggatcgcatcaagggcggcatctacaaattcaagggcgtcgcgcgcgtgggcgacagcgtcgcgtgcgaggccgagatcatgtgcaccatgcgcacggtggcctga

SEQ ID NO: 218 - protein, 146 aa, Acidovorax sp. JS42
MMDIHQILKLLPHRYPFLLVDRVNELERGKRILAIKNVTINEPFFTGHFPARPVMPGVLILEALAQAAGLLSFDMMGEAPGDDKVFYFVGIDGARFKRPVEPGDQLILDVELDRIKGGIYKFKGVARVGDSVACEAEIMCTMRTVA

SEQ ID NO: 219 - DNA, 462 bp, Synechococcus sp. RS9916
  CDS (1)..(462): transl_table=11
ttgacccaggcttccaccacacccgcggaaccgctcctcaacagcgagcagatcatggggttgctgccccatcgctatcccttcgctctggtggatcgggtgctggagcacgagcccggcgtgcgtgcggtggcgatcaaaaacatcaccctcaatgaaccccagtttcagggccatttccctgacaggcctttgatgcccggggtgttgatcgtggaagcgatggcccaggtgggtggcctgatcgtgaagcagatgcccgatctgcccaatggcctgtttgtgttcgccggaattgatggtgttcgcttccgcaggcctgtggtgcccggtgatcagctgcgcatcagttgcgagttggtcagccttaagcggaagcggttcggcaaggtgaaagccgaggccaccgtggatggtcagctggtctgctccggagacctgatgttctcgatgatggactga

SEQ ID NO: 220 - protein, 153 aa, Synechococcus sp. RS9916
MTQASTTPAEPLLNSEQIMGLLPHRYPFALVDRVLEHEPGVRAVAIKNITLNEPQFQGHFPDRPLMPGVLIVEAMAQVGGLIVKQMPDLPNGLFVFAGIDGVRFRRPVVPGDQLRISCELVSLKRKRFGKVKAEATVDGQLVCSGDLMFSMMD

SEQ ID NO: 221 - DNA, 432 bp, Vibrio sp. Ex25
  CDS (1)..(432): transl_table=11
atgaacatctctgaaattcaagagctactacctcatcgctacccattcttattgatcgaccgagtgatagacttccaagaagagaagtaccttcacgcgattaaaaacgtgtcggttaacgaacctcagttcacaggtcactttcctcaactaccagtattcccaggtgttttgattttagaagcaatggctcaggcaacaggcttacttgcatttaaatcatttggtgcaccaacagaaaatgaactgtactactttgcaagcgtagacggcgcgaaattccgtaaaccagtggttccgggcgaccaattggttattgaggtagaatttctgaaagaacgtcgcggcattgctgcatttagcggtgtagcaaaagttgacggcgaagtggtatgttctgcagaactgaagtgtgctcgtcgagagttttaa

SEQ ID NO: 222 - protein, 143 aa, Vibrio sp. Ex25
MNISEIQELLPHRYPFLLIDRVIDFQEEKYLHAIKNVSVNEPQFTGHFPQLPVFPGVLILEAMAQATGLLAFKSFGAPTENELYYFASVDGAKFRKPVVPGDQLVIEVEFLKERRGIAAFSGVAKVDGEVVCSAELKCARREF

SEQ ID NO: 223 - DNA, 453 bp, Alteromonadales bacterium TW-7
  CDS (1)..(453): transl_table=11
ttggcaaacgaattaaatagccttgatattcaagaaatcttagctttattaccacaccgttacccgatgcttttaattgatcgtgttattgattttactccgggtaagacattgcatgccattaaaaatgtatctataaatgagcctatttttactggccattttccaaaccagcctattttccctggtgtgctaatattagaagctatggcacaagctacaggtcttcttggttttaaaacagttgaaaatcgcagcgaagacgagctttacttatttgcagcagtagacaacgctcgttttaagcaaccggttgtgcctggtgatacattgcatttgcatgtagagtttttaaaagagcgccgcaatatatggaagtttgctgctgaagctaaagttgacggcaaagtagtatgtagtgccgaaattatgtgtgcgagaagagagttttaa

SEQ ID NO: 224 - protein, 150 aa, Alteromonadales bacterium TW-7
MANELNSLDIQEILALLPHRYPMLLIDRVIDFTPGKTLHAIKNVSINEPIFTGHFPNQPIFPGVLILEAMAQATGLLGFKTVENRSEDELYLFAAVDNARFKQPVVPGDTLHLHVEFLKERRNIWKFAAEAKVDGKVVCSAEIMCARREF

SEQ ID NO: 225 - DNA, 438 bp, marine gamma proteobacterium HTCC2143
  CDS (1)..(438): transl_table=11
atgatgggaataaaggaaatacaggagtatctgccacatcggtttccttttttgttagttgatcgcgttgaggaggttactaaaggtgaatcgatcattgcgattaagaacgtgtctatcaatgaacctttttttcaaggacatttcccgcaggttgccgtaatgccgggggtacttattgttgaagctatggcgcaggcagccgctatccttggttttaaaacacaggataaaacaccggcagacggatcgctctatttatttgtcggggcagataatgtccgtttcaggcgtcaggtagtaccgggagatcagttgctattaaatgtagcctatgtatctgatcgtcgcggaatctggaagtttaagtgtacgtcatacgttgataaagagttggctgcgtcggcggatattatttgcgccgatagaccattttga

SEQ ID NO: 226 - protein, 145 aa, marine gamma proteobacterium HTCC2143
MMGIKEIQEYLPHRFPFLLVDRVEEVTKGESIIAIKNVSINEPFFQGHFPQVAVMPGVLIVEAMAQAAAILGFKTQDKTPADGSLYLFVGADNVRFRRQVVPGDQLLLNVAYVSDRRGIWKFKCTSYVDKELAASADIICADRPF

SEQ ID NO: 227 - DNA, 435 bp, marine gamma proteobacterium HTCC2080
  CDS (1)..(435): transl_table=11
atgattatggatatcgctgcgatacgggagcacctaccccaccgctatccatttttgttggttgatagagtcattgatctggagcttggtgaatcaattcacgcctataaaaacttgagtattaatgagccttatttcgatggccattttcctgagcagccagtatttcccggtgtgctattagtcgaggcaatggcacaggcggcgggaatattgggttttaaaacaatgggaaaaacgcctaaagatggttcactttactatcttgttggggtcgacaagctgcgctttaagcggccttgtgtacccggggaccgtgttgatctattcgcaaaaattgtgagtgagcgacgtggcatctggaagtttgatgtccactctgaagtcgagggcgctacctgcgcctcggcaactattctctgcgcagaccgctag

SEQ ID NO: 228 - protein, 144 aa, marine gamma proteobacterium HTCC2080
MIMDIAAIREHLPHRYPFLLVDRVIDLELGESIHAYKNLSINEPYFDGHFPEQPVFPGVLLVEAMAQAAGILGFKTMGKTPKDGSLYYLVGVDKLRFKRPCVPGDRVDLFAKIVSERRGIWKFDVHSEVEGATCASATILCADR

SEQ ID NO: 229 - DNA, 426 bp, Enterococcus faecalis
  CDS (1)..(426): transl_table=11
atgaaattaacaattacagaaattcaagaaattttaccacatcgctatccctttttattattagatagtgttgaagaagtcattcccggggaacgcgttgtagcgaaaaagaatgtaacggttaatgagcaagtttttcaaggtcattttcctgggaatcctgttttgccaggagttttaattattgaatcgttggctcaagcaggcgccgtggcattactttcaatgcctgaattcaaagggaaaacggcatactttggtggattagataaagcaaaatttagacaaaaggtaacaccaggcgacacattaattttagaggttgaacttttaaaagtccgcgcttctgctggaatgggtaaaggtgtggcaaaagttaatggaaaaaaagttgccgaggctgaattaacctttatgattggatag

SEQ ID NO: 230 - protein, 141 aa, Enterococcus faecalis
MKLTITEIQEILPHRYPFLLLDSVEEVIPGERVVAKKNVTVNEQVFQGHFPGNPVLPGVLIIESLAQAGAVALLSMPEFKGKTAYFGGLDKAKFRQKVTPGDTLILEVELLKVRASAGMGKGVAKVNGKKVAEAELTFMIG

SEQ ID NO: 231 - DNA, 516 bp, Anabaena sp
  CDS (1)..(516): transl_table=11
atgtcaaccctctctgaagtgaaagcacccacatctacagaacaacccgccactaatgaggcgacgacaccacccgaaattaaaacgacttttacatctgaagaaattcagaaattattaccccaccgctacccgttcttgcttgtagacaaaattattgactacacaccaggaaaacaggcagtaggtattaaaaatgtcactattaacgagccacatttcaccggtcatttcccagatagaccactaatgccaggagtactaattgtcgaagcaatggctcaagtaggtggtattgtgatgacgcaactgccaggcttagaaggtggtttatttgtattcgcgggtattgataaagtccgtttccgccgtcaagtagtaccaggagaccaactggtaatgacagtggaactgttatggattaaacaacgtcgtttcggtaaaatgcaagcccgtgcagaagttgacggtcaactagcagccgaaggcgaattaatgttttcgctgatcaactag

SEQ ID NO: 232 - protein, 171 aa, Anabaena sp
MSTLSEVKAPTSTEQPATNEATTPPEIKTTFTSEEIQKLLPHRYPFLLVDKIIDYTPGKQAVGIKNVTINEPHFTGHFPDRPLMPGVLIVEAMAQVGGIVMTQLPGLEGGLFVFAGIDKVRFRRQVVPGDQLVMTVELLWIKQRRFGKMQARAEVDGQLAAEGELMFSLIN

SEQ ID NO: 233 - DNA, 453 bp, Aquifex aeolicus
  CDS (1)..(453): transl_table=11
atggatattcaagagataatggaaatacttccgcacaggtatcccattctcttagtagataaaatccttgaaatagaagaaggaaaaaggatcattggtttaaagaacgtgagcgttaacgagccggtttttcaggggcactttcccggctttcccctctttccgggggtttacatactggaggctatggctcaggtgggggggattttaatgataaagtcccttaaccttgaaattggaaagtacgcagttgtttttgcaggtatagacgacgcgaggtttaaaaaacccgtttacccgggagaccagcttatactcgagcttgaagttatatctcttaaaaaggcactttcaaagatgaagggggttgcaaaggtggacggggaagttgtggcacaggctacgctgatggcagccgcgagaaaacttgaagacattaaaaggaatgcctga

SEQ ID NO: 234 - protein, 150 aa, Aquifex aeolicus
MDIQEIMEILPHRYPILLVDKILEIEEGKRIIGLKNVSVNEPVFQGHFPGFPLFPGVYILEAMAQVGGILMIKSLNLEIGKYAVVFAGIDDARFKKPVYPGDQLILELEVISLKKALSKMKGVAKVDGEVVAQATLMAAARKLEDIKRNA

SEQ ID NO: 235 - DNA, 438 bp, Azoarcus sp
  CDS (1)..(438): transl_table=11
atggatatcaacgaaattctccagtaccttccgcaccgctatccctttctgctcgtggatcgcgtgctggagatcgaagaaggcaagcgcatcctcgcgctgaagaacgtgacgatgaacgagccgttctttcccggccacttcccgcatcacccggtgatgccgggcgtgctgatcgtcgaggcgatggcgcaggccgccgcgctgctgtcgttcaagagcatgggcgtcaagcccgacgagaactcggtggtgtattttgccggcatcgacaacgtgcgcttcaagcgcccggtggttcccggcgaccagctgctgttcgacgtcgtcatcacgcagagcaagcgcaacatctacaagtacaagggggtcgcccgcgtcgacggcgagctcgcgaccgaagccgagctgacctgcgcgctcaagacgctgtcatga

SEQ ID NO: 236 - protein, 145 aa, Azoarcus sp
MDINEILQYLPHRYPFLLVDRVLEIEEGKRILALKNVTMNEPFFPGHFPHHPVMPGVLIVEAMAQAAALLSFKSMGVKPDENSVVYFAGIDNVRFKRPVVPGDQLLFDVVITQSKRNIYKYKGVARVDGELATEAELTCALKTLS

SEQ ID NO: 237 - DNA, 435 bp, Bacillus licheniformis
  CDS (1)..(435): transl_table=11
atgcttgatgctcagcaaattaaagaaatcattccccaccgctatccctttctgctggtagaccgtgtgacagaagtagaggaaggaaaacgggccgcgggttataaaaatgtgacagtaaatgaagagttttttaacggacactttccggattatccggtgatgcctggtgttttaattgttgaagcgcttgcgcaagtaggtgcggtggcgcttttgatgaaggaagaaaaccgcggaaggctcgcgttttttgcgggaattgacagctgccgcttcaaaaagcaggtgaaaccgggcgatcagctccatcttgagcttgaagtgcttcgtttccgcggttccatcggcaaaggaaaaggagtcgcaaaagtggacggagaagtcgtgtgtgaagccgaattgatgttttctcttggtgaaaagcaggaataa

SEQ ID NO: 238 - protein, 144 aa, Bacillus licheniformis
MLDAQQIKEIIPHRYPFLLVDRVTEVEEGKRAAGYKNVTVNEEFFNGHFPDYPVMPGVLIVEALAQVGAVALLMKEENRGRLAFFAGIDSCRFKKQVKPGDQLHLELEVLRFRGSIGKGKGVAKVDGEVVCEAELMFSLGEKQE

SEQ ID NO: 239 - DNA, 456 bp, Bordetella bronchiseptica
  CDS (1)..(456): transl_table=11
atggaactcgacatcaaggggatcatggaccggctgccgcatcgctacccgatgctgctgatcgaccgtgtgctggagatggtgcccggcaaatccatcgttgccatcaagaacgtctcgatcaacgagccgtttttcacgggccattttccgcatcatccggtcatgccgggcgtgctgatcgtcgaggccatggcgcaggcttcggccctgttctcgttcaccgacgagaacggcgggctgaagtgcgacggcgccaagaccgcctactacctggtgggcatcgacggcgcgcggttccgtaaacccgtggtgccgggcgaccagttgcggctggaagtcgaggccgagcgcctgtcgcgtaccatctgcaagtaccagggccgggccctggtcgacggccaactggtcgccgaagccaagctgatgtgcgcgatccgtagcctggaagagtaa

SEQ ID NO: 240 - protein, 151 aa, Bordetella bronchiseptica
MELDIKGIMDRLPHRYPMLLIDRVLEMVPGKSIVAIKNVSINEPFFTGHFPHHPVMPGVLIVEAMAQASALFSFTDENGGLKCDGAKTAYYLVGIDGARFRKPVVPGDQLRLEVEAERLSRTICKYQGRALVDGQLVAEAKLMCAIRSLEE

SEQ ID NO: 241 - DNA, 456 bp, Bordetella parapertussis
  CDS (1)..(456): transl_table=11
atggaactcgacatcaaggggatcatggaccggctgccgcatcgctacccgatgctgctgatcgaccgtgtgctggagatggtgcccggcaaatccatcgttgccatcaagaacgtctcgatcaacgagccgtttttcacgggccattttccgcatcatccggtcatgccgggcgtgctgatcgtcgaggccatggcgcaggcttcggccctgttctcgttcaccgacgagaacggcgggctgaagtgcgacggcgccaagaccgcctactacctggtgggcatcgacggcgcgcggttccgtaaacccgtggtgccgggcgaccagttgcggctggaagtcgaggccgagcgcctgtcgtgtaccatctgcaagtaccagggccgggccctggtcgacggccaactggtcgccgaagccaagctgatgtgcgcgatccgtagcctggaagagtaa

SEQ ID NO: 242 - protein, 151 aa, Bordetella parapertussis
MELDIKGIMDRLPHRYPMLLIDRVLEMVPGKSIVAIKNVSINEPFFTGHFPHHPVMPGVLIVEAMAQASALFSFTDENGGLKCDGAKTAYYLVGIDGARFRKPVVPGDQLRLEVEAERLSCTICKYQGRALVDGQLVAEAKLMCAIRSLEE

SEQ ID NO: 243 - DNA, 459 bp, Buchnera aphidicola subsp
  CDS (1)..(459): transl_table=11
ttgaattctgatgaatatatttttaatattaaagatattttaaatattttaccgcatcgctatccttttttacttattgatcggattttagattttaaagcatttcaatatttaaaagcacttaaaaactgtactgtaaatgaacctttttttcaaggtcattttataaaagaacctgtttttcctggtgttttaatgattgaagctatgagtcaagcggctgctgttttgatttttaaaagcataggtaaattgaatattaatcagttgtactacttcgtaggtattgagaatacgcgatttaaaaaaattgtagtgcctggtgatcaaatatttattgaagtaatatacctaaagtctaaaaaaaactttataaaatttaaaatttttgccatagtgaataaaaagaatgtttgtaaatctacaataattttttataaaaaaaatatctttaattga

SEQ ID NO: 244 - protein, 152 aa, Buchnera aphidicola subsp
MNSDEYIFNIKDILNILPHRYPFLLIDRILDFKAFQYLKALKNCTVNEPFFQGHFIKEPVFPGVLMIEAMSQAAAVLIFKSIGKLNINQLYYFVGIENTRFKKIVVPGDQIFIEVIYLKSKKNFIKFKIFAIVNKKNVCKSTIIFYKKNIFN

SEQ ID NO: 245 - DNA, 468 bp, Burkholderia mallei
  CDS (1)..(468): transl_table=11
atgagcactgaaaaaatcaacttcgacattcacaagatcctcacgctgctgccgcaccgctatccgattctgctcgtcgatcgcgtgctcgaactcgaaccgcacaaggccatcaaggcgctgaagaacgtgacggtcaacgagccgttcttcaccggccacttcccgaagcggccggtgatgccgggcgtgctgatcatcgaggcgctcgcgcaggcggccgcgctcctcacgttcgccgaggcgcagccgaaggatccggagaacacgctgtattacttcgtcggcatcgacaacgcgcgcttcaagcgcgtcgtcgagccgggcgaccagttgatcctgaacgtgacgttcgagcgctatattcgcggcatctggaagttcaaggccgttgcggaagtggacggcaaggtcgcggcggaagccgagctgatgtgcacggtcaagacggccgacgcggcgccctga

SEQ ID NO: 246 - protein, 155 aa, Burkholderia mallei
MSTEKINFDIHKILTLLPHRYPILLVDRVLELEPHKAIKALKNVTVNEPFFTGHFPKRPVMPGVLIIEALAQAAALLTFAEAQPKDPENTLYYFVGIDNARFKRVVEPGDQLILNVTFERYIRGIWKFKAVAEVDGKVAAEAELMCTVKTADAAP

SEQ ID NO: 247 - DNA, 468 bp, Burkholderia sp
  CDS (1)..(468): transl_table=11
atgagcactgaaaaaatcaatctcgacatccacaagatcctcacgctgctgccgcatcgctacccgattctgctcgtcgatcgcgtgctcgaactcgaaccgcacaagggaatcaaagcgctgaagaacgtgtcgatcaacgagccgtacttccaggggcatttcccgaagcggccggtgatgccgggcgtgctgatcctcgaagcgcttgcgcaggccgcggcgctgctgaccttctcggaagagcagccgaaggatccggagaacacgctgtactacttcgtcgggatcgacggcgcgcgcttcaagcgtccggtcgagccgggcgaccaactgattctgaacgtgacgttcgaacgctacatccgcggcatctggaaattcaaggcggtggcggaagtggacggcaaggtggcggcggaagccgagctgatgtgcacggtcaagacgaccgacgtggcgccctga

SEQ ID NO: 248 - protein, 155 aa, Burkholderia sp
MSTEKINLDIHKILTLLPHRYPILLVDRVLELEPHKGIKALKNVSINEPYFQGHFPKRPVMPGVLILEALAQAAALLTFSEEQPKDPENTLYYFVGIDGARFKRPVEPGDQLILNVTFERYIRGIWKFKAVAEVDGKVAAEAELMCTVKTTDVAP

SEQ ID NO: 249 - DNA, 483 bp, Burkholderia thailandensis
  CDS (1)..(483): transl_table=11
gtgagacgaaccatcatgagcactgaaaaaatcaacttcgacattcacaagatcctcacgctgctgccgcaccggtatccgattctgctcgtcgatcgcgtgctcgaactcgaaccgcacaagtccatcaaagcgttgaagaacgtgacggtcaacgagccgttcttcaccggccacttcccgaagcggccggtgatgccgggcgtgctgatcatcgaagcgctcgcgcaggcggccgcgctcctcacgttcgccgaggcggagccgaaggatccggagaacacgctgtattacttcgtcggcatcgacaacgcgcgcttcaagcgcgtcgtcgagccgggcgatcaactgatcctgaacgtgacgttcgagcgctatattcgcggcatctggaagttcaaggccgttgcggaagtggacggcaaggtcgcggcggaagccgagctgatgtgcacggtcaagacggccgacgcggcgccctga

SEQ ID NO: 250 - protein, 160 aa, Burkholderia thailandensis
MRRTIMSTEKINFDIHKILTLLPHRYPILLVDRVLELEPHKSIKALKNVTVNEPFFTGHFPKRPVMPGVLIIEALAQAAALLTFAEAEPKDPENTLYYFVGIDNARFKRVVEPGDQLILNVTFERYIRGIWKFKAVAEVDGKVAAEAELMCTVKTADAAP

SEQ ID NO: 251 - DNA, 435 bp, Carboxydothermus hydrogenoformans
  CDS (1)..(435): transl_table=11
atgagtgaggcaattaaagacattaccgaaattatgaatatattaccccacaggtatccctttttactggtggacaagattctggaggttgtacccggggaaaaagcggttggaattaaaaatgtcacaataaacgaacccttttttcaagggcacttcccggggcggcctattatgccaggggttttactattagaagccatggcccaggtaggagctgtggcaattttaaccgatgaacgttatgccggaaagcttccgatgtttgccggtattgatggtgcccgctttagaaagccggtattaccgggagatcaggtggtttttgaagttgaactcttaaaaataaaagggagtcttgggaaagccagagggtcgggaaaagttaatggtgagttagtggttgaagcggaaattttatttgcccttgcttaa

SEQ ID NO: 252 - protein, 144 aa, Carboxydothermus hydrogenoformans
MSEAIKDITEIMNILPHRYPFLLVDKILEVVPGEKAVGIKNVTINEPFFQGHFPGRPIMPGVLLLEAMAQVGAVAILTDERYAGKLPMFAGIDGARFRKPVLPGDQVVFEVELLKIKGSLGKARGSGKVNGELVVEAEILFALA

SEQ ID NO: 253 - DNA, 453 bp, Chromobacterium violaceum
  CDS (1)..(453): transl_table=11
atgagtgaacacgctgtctcgatcgatgtccgcgagatcatgcgctgcctgccgcatcgttacccgttcctgctggttgaccgcgtcaccgaaatggagcccaacgtgcgcatcaaggcgctgaagaacgtcaccatcaacgagccgttcttcgtcggccacttcgaacaatatccggtgatgccgggcgtgctgatcatcgaggcgctggcccaggccgccggcatcctggcgatcaagagccagggcgaacgcttggagaacgagctgtacttcttcgtcggcatcgacaacgcccgcttcaagcgccaggtggtgccgggcgaccaactggtgttcgaagtgacgcagatgaccgtcaagcgcggcatcggcaagtacgccgcgcgcgcgctggtggacggccaggtggcttgcgaagccgagatcatgtgcgcgcgccgcgaggtgtga

SEQ ID NO: 254 - protein, 150 aa, Chromobacterium violaceum
MSEHAVSIDVREIMRCLPHRYPFLLVDRVTEMEPNVRIKALKNVTINEPFFVGHFEQYPVMPGVLIIEALAQAAGILAIKSQGERLENELYFFVGIDNARFKRQVVPGDQLVFEVTQMTVKRGIGKYAARALVDGQVACEAEIMCARREV

SEQ ID NO: 255 - DNA, 453 bp, Colwellia psychrerythraea
  CDS (1)..(453): transl_table=11
ttggaaactgtaaaaaaacctatcgatcttaacgaaataaaaacgttaatacctcacagatacccaatgttattagttgataaagtaatagatcatgaaccaggtaaaaccttacatgctattaaaaatgtcacaataaatgagcctgtatttacagggcattttcctgaactagccatttttcccggtgttttaattttagaagcattagcacaagctacaggtatccttggttttaaaagcacagaagggcgtggtgataatgaaatgtatttatttgcctcaatagataaagcaaaatttaaaaaacctgtgttaccaggtgataccatgcacttacatgttgaatttctcaaagaacgtcgaggaatgtggaagttttatggtgaagctagagttgatggcaaagtggtttgtagtgctgaccttatgtgtgcacgtcgccctttatag

SEQ ID NO: 256 - protein, 150 aa, Colwellia psychrerythraea
METVKKPIDLNEIKTLIPHRYPMLLVDKVIDHEPGKTLHAIKNVTINEPVFTGHFPELAIFPGVLILEALAQATGILGFKSTEGRGDNEMYLFASIDKAKFKKPVLPGDTMHLHVEFLKERRGMWKFYGEARVDGKVVCSADLMCARRPL

SEQ ID NO: 257 - DNA, 438 bp, Coxiella burnetii
  CDS (1)..(438): transl_table=11
atgaacgtcatgaatattacagacattaaaaaatacattcctcaccgttatccttttctcctcattgatcgggtaatcaaaatagaaaaagataaatccttagtcgctattaaaaatgtcacggtgaatgaacctttttttacaggacattttcctgtgcgacccgtcatgccaggtgttttaattattgaatcattggcgcaagccgctggcattttaattgttaaatcattaaatttgccagaaggccataaagacatttatttctttgcaggagtagataacgctcgttttaagcgcgtcgttgagcctggagatcaattaactttagaggtgaaagtattaaaagttcaccgcggtctatggaagtttgaagggaaagcgacggtagacgaccagctcgcttgtaaagccgagttgatgaccattaagggataa

SEQ ID NO: 258 - protein, 145 aa, Coxiella burnetii
MNVMNITDIKKYIPHRYPFLLIDRVIKIEKDKSLVAIKNVTVNEPFFTGHFPVRPVMPGVLIIESLAQAAGILIVKSLNLPEGHKDIYFFAGVDNARFKRVVEPGDQLTLEVKVLKVHRGLWKFEGKATVDDQLACKAELMTIKG

SEQ ID NO: 259 - DNA, 435 bp, Dechloromonas aromatica
  CDS (1)..(435): transl_table=11
atggatattatcgagattcttgagcatcttccgcaccgctatccgttcttgctggttgaccgggtactcgaaatcgaaccgggcaaatccattcacgcctacaagaacgtgacgatcaatgagccgttcttcgtcggacattttcctcatcatcctgtgatgccgggcgtgttgatcatggaagcgctggctcaggcggccgggattctttctttcaagtcgatggatgagaagccgtcgccggataccgtcttctacttcgccggcatcgacgaggctcgtttcaagaagccggtgatgccaggtgaccagctacacctgcatatcgagatcgagcgtcaaatgcgtggcgtctggaagtacaaggccgaagcgcgcgtcgacgggcagctggctgcctcggccaaattgatgtgtgccaagcgggatctctaa

SEQ ID NO: 260 - protein, 144 aa, Dechloromonas aromatica
MDIIEILEHLPHRYPFLLVDRVLEIEPGKSIHAYKNVTINEPFFVGHFPHHPVMPGVLIMEALAQAAGILSFKSMDEKPSPDTVFYFAGIDEARFKKPVMPGDQLHLHIEIERQMRGVWKYKAEARVDGQLAASAKLMCAKRDL

SEQ ID NO: 261 - DNA, 438 bp, Deinococcus radiodurans
  CDS (1)..(438): transl_table=11
atgtccctcatgacccctctgctgattcgggacgttctgaaggccctgccccaccgttatcccttcgtgctggtggaccgcgtgttcagcacggaaaatggcgaagtccatgcgctgaaaaacgtcaccatcaacgagccgtttttcatggggcactttcccaccgagcccgtcatgcccggcgtgctgattaccgaggcactggcgcaggcgagcatgttttgcctgcacgggcagatggaaccgggccagatcggctatctggcgggcatcgagggcgcccgcttcaagcgcaaggtgattcccggcgaccaactgcacctgcacgccaaactggaatttctgcgccggggcctgggcaaaaccacctgccgcgccgaggtagacggcgaagtggcggcggagatgcagattctgtttgcagtggcgaagggctga

SEQ ID NO: 262 - protein, 145 aa, Deinococcus radiodurans
MSLMTPLLIRDVLKALPHRYPFVLVDRVFSTENGEVHALKNVTINEPFFMGHFPTEPVMPGVLITEALAQASMFCLHGQMEPGQIGYLAGIEGARFKRKVIPGDQLHLHAKLEFLRRGLGKTTCRAEVDGEVAAEMQILFAVAKG

SEQ ID NO: 263 - DNA, 465 bp, Desulfovibrio desulfuricans
  CDS (1)..(465): transl_table=11
atgaacgacaaggcgaaaagcattttggatattcgacagattctgggactgctgccgcaccggtatccttttctgctggtggacagagtgctcgactacacccccggcgagtgcattaccgctgtaaaaaacgtcaccatgaacgagcctttttttcaggggcattttcctgatgtgccggtaatgcccggcgtgctcattatggaagcgcttgcgcaggccggtggcattctggtggtcaaaagcaccgacaccagcgtggaaggtaagctttttctgtttacaggcatggaaagagtgcgcttcagaaagccggtataccccggcgacaggctggagctgcattgccgccttttgcgccacaagctaaagctgtggaagatggaaggcaaagcctatgtggacggacagcttgctgccgaagccgaaatgaccgccgctgtcatgaacagagaggatatgtag

SEQ ID NO: 264 - protein, 154 aa, Desulfovibrio desulfuricans
MNDKAKSILDIRQILGLLPHRYPFLLVDRVLDYTPGECITAVKNVTMNEPFFQGHFPDVPVMPGVLIMEALAQAGGILVVKSTDTSVEGKLFLFTGMERVRFRKPVYPGDRLELHCRLLRHKLKLWKMEGKAYVDGQLAAEAEMTAAVMNREDM

SEQ ID NO: 265 - DNA, 465 bp, Desulfovibrio vulgaris
  CDS (1)..(465): transl_table=11
atgatcgacccggcgcagagcattcttgatatccgtcagatactggggctgttgccccaccgttatcccttcctgctcgtcgaccgtgtggtcgaatacgttccgggcgactacatcaaggcctacaagaacgtcaccatgaacgagcccttctttcaggggcatttccccggcgtgcccgtcatgcccggtgtgctcatcatggaagcgttggcacaggccggtggcattctcgtggtcaagagcaccgacacagccgtcgaggacaagctctttctcttcacgggcatcgagtcggtgcgtttccgcaagccggtctaccccggcgacaagctggaattgcactgccgcctgctcaagcacaagctcaagctgtggaagatggaagggcgtgcctacgtcgacggcaaacttgccgccgaagccgtgatgaccgccgccgtgaccaacagggaggacatgtga

SEQ ID NO: 266 - protein, 154 aa, Desulfovibrio vulgaris
MIDPAQSILDIRQILGLLPHRYPFLLVDRVVEYVPGDYIKAYKNVTMNEPFFQGHFPGVPVMPGVLIMEALAQAGGILVVKSTDTAVEDKLFLFTGIESVRFRKPVYPGDKLELHCRLLKHKLKLWKMEGRAYVDGKLAAEAVMTAAVTNREDM

SEQ ID NO: 267 - DNA, 456 bp, Erwinia carotovora subsp
  CDS (1)..(456): transl_table=11
ttgactactgacactcatactctgaatattgaagagattttagaattattaccgcaccgtttcccgtttttactggttgatcgggtactggattttgaaaaagggaagtttctgcgggcggtgaaaaacgtctctttcaacgaacccttcttccaggggcatttcccgggtaaacccatttttcccggtgtgttgattctggaagccatggctcaggctacgggtatcctggcgtttaaaagcgtcggtaaactggagccgggtgagctgtactatttcgccgctgtggacgaagcgcgctttaagcgccccgtgcagccaggcgatcaaatgatccttgaagttgaattcattaaagagcgtcgtggcgttgcgcgctttaaaggtgttgccaaagttgatggcgaagtggcctgtgaagcgtcaatgatgtgtgctcgtcgtcgggagtcctga

SEQ ID NO: 268 - protein, 151 aa, Erwinia carotovora subsp
MTTDTHTLNIEEILELLPHRFPFLLVDRVLDFEKGKFLRAVKNVSFNEPFFQGHFPGKPIFPGVLILEAMAQATGILAFKSVGKLEPGELYYFAAVDEARFKRPVQPGDQMILEVEFIKERRGVARFKGVAKVDGEVACEASMMCARRRES

SEQ ID NO: 269 - DNA, 438 bp, Geobacillus kaustophilus
  CDS (1)..(438): transl_table=11
atgcttgacatccagcaaatccagtccatcatcccgcaccgctatccgtttttgcttgtcgaccgcattctggaaatcgaagaaggcaagcgcgccgtcggcatcaaaaacgtcagcgccaacgaatcatttttcgccggccatttcccggaatacccggtcatgcccggcgtgttgatcgtcgaggcgctcgcccaagtcggcgccgtcgtcctcctgcaaagcgaggaaaaccgcggccgcctcgccttcttcgccggcatcgacaactgccgttttaaaaagcaagtcaaaccgggcgaccagctccgcttggaagtcgaaatcctccgcgcccgcggcgccatcggcaaaggcaaaggcatcgccaccgtcgacggcgagcttgtctgcgaaacggagttgatgttcgctcttggcgacaaacgagctgactga

SEQ ID NO: 270 - protein, 145 aa, Geobacillus kaustophilus
MLDIQQIQSIIPHRYPFLLVDRILEIEEGKRAVGIKNVSANESFFAGHFPEYPVMPGVLIVEALAQVGAVVLLQSEENRGRLAFFAGIDNCRFKKQVKPGDQLRLEVEILRARGAIGKGKGIATVDGELVCETELMFALGDKRAD

SEQ ID NO: 271 - DNA, 453 bp, Geobacter metallireducens
  CDS (1)..(453): transl_table=11
atggaaactgtctttgatatcaatgaaatcatgaaaatccttccccaccgttacccctttctcctggtggaccggatcgtggagcacgtgccgggagaaaggatcgtggggatcaagaacgttaccatcaacgagcctttcttccagggacatttccccggtcatcccatcatgccgggggtgctgattgtcgaggccatggcccaggtgggtggtatccttgcatacatggcatcggacgacgaagtccggaataaagtctgctattttgcttccattgacaacgtgaaattccgcaagccggtgctgccgggagaccaactccggatcgaggttgcggccaccgggtgcaagcgcggcatctggtgtttcagcgccaaggccattgtcaaggggaaggtgacgacccaggcggaactcaaggccacctttgccgacaaggacaggttgtaa

SEQ ID NO: 272 - protein, 150 aa, Geobacter metallireducens
METVFDINEIMKILPHRYPFLLVDRIVEHVPGERIVGIKNVTINEPFFQGHFPGHPIMPGVLIVEAMAQVGGILAYMASDDEVRNKVCYFASIDNVKFRKPVLPGDQLRIEVAATGCKRGIWCFSAKAIVKGKVTTQAELKATFADKDRL

SEQ ID NO: 273 - DNA, 453 bp, Geobacter sulfurreducens
  CDS (1)..(453): transl_table=11
atggaaacagtctttgatatcaacgaaatcatgaagattcttccccaccgctaccccttcctcctggtggatcggattgtggagtacgttgccggcgagcggatcgtggggatcaagaacgtcagcatcaatgagccgtttttccaaggccactttccgggacacccggtgatgccgggagtcctgatcgttgaggccatggcccaggtggggggaatctacgcctatgtgaccttgggcgacgaggtccgcgacaaggtctgctactttgcctccatcgacaacgtcaagttccgcaaaccggtggtgccgggagaccaactgcggatcgaagtaacgatctccggttgcaagcggggcatctggtgcttcagcgccagggccaccgtgaacggcaagctggtcaccgaggcggagctcaaggcgacctttgccgacaaggaaaaactctaa

SEQ ID NO: 274 - protein, 150 aa, Geobacter sulfurreducens
METVFDINEIMKILPHRYPFLLVDRIVEYVAGERIVGIKNVSINEPFFQGHFPGHPVMPGVLIVEAMAQVGGIYAYVTLGDEVRDKVCYFASIDNVKFRKPVVPGDQLRIEVTISGCKRGIWCFSARATVNGKLVTEAELKATFADKEKL

SEQ ID NO: 275 - DNA, 429 bp, Gloeobacter violaceus
  CDS (1)..(429): transl_table=11
atgatcgacaacatcgaaattcagaagatcctcgcccaccgctacccgtttttactcgtcgaccgcgtgctcgtcttcgagccgggggtgcgggcggtcggcatcaaaaacgtcaccatcaacgagccgttcttccaggggcacttccccggccggccgctgatgccgggggccttgctcatcgaggcgatggcccaggtgggcggcatcgtctgcgggcagttgcccgaggcggtgggcaagatcccgctgctggtgggggtcaacaagacccgctttcgccgccaggtggtgccgggtgatcaggtgatcatcaccgctgaggatctgcgcacccgccagaagcgcttcgggatcatgcagacccgctcggaggtcgatggcaaactggtagccgaagccgagattatgttttccctggtagattga

SEQ ID NO: 276 - protein, 142 aa, Gloeobacter violaceus
MIDNIEIQKILAHRYPFLLVDRVLVFEPGVRAVGIKNVTINEPFFQGHFPGRPLMPGALLIEAMAQVGGIVCGQLPEAVGKIPLLVGVNKTRFRRQVVPGDQVIITAEDLRTRQKRFGIMQTRSEVDGKLVAEAEIMFSLVD

SEQ ID NO: 277 - DNA, 465 bp, Haemophilus ducreyi
  CDS (1)..(465): transl_table=11
atggcgattgaaacagcagaaaatcgaacccctaaggttattgaagttactgagattatgaatatgctaccacatcgttatccttttcttttagtggatcgtgtaacagattatgaagaaggcaaatggttgagagcaatcaaaaatgtaaccgtaaatgaaccttgttttaccggtcattttcctagcagtcccgtctttcctggcgtactcattttagaagccatggcacaagctacaggcgttctagccgtggctacatatggtaaaatgcgtgaagatgaactttattactttgctgcaattgacaatgcacgttttaaacgccctgttgtaccaggtgatcaacttgtacttgaagtagaatttctaaaagaaatacgtggcattacaaaattcacaggtaaagcttatgttaatggtaaattagcctgtgaagcagacttgatgtgtgcacgtaaataa

SEQ ID NO: 278 - protein, 154 aa, Haemophilus ducreyi
MAIETAENRTPKVIEVTEIMNMLPHRYPFLLVDRVTDYEEGKWLRAIKNVTVNEPCFTGHFPSSPVFPGVLILEAMAQATGVLAVATYGKMREDELYYFAAIDNARFKRPVVPGDQLVLEVEFLKEIRGITKFTGKAYVNGKLACEADLMCARK

SEQ ID NO: 279 - DNA, 447 bp, Haemophilus influenzae
  CDS (1)..(447): transl_table=11
gtgtcagaacaacaaccaagagtgatcgaatcaaaagaaattatgactttattgccacatcgctacccatttttgttagtggatcgcgtattggattttaaagaaggcgaatggttaaaagcgattaaaaatatcagcgtgaatgagccttgtttcacaggtcacttcccaggcgaacccattttaccgggcgttttaattttagaagctttggcacaagcaatgggcattttagcctttaaaactctcgaattaaaaggcggcgaactattctactttgcaggtattgatgaagcgcgctttaaacgcccggtgttacctggagatcaaatggaattaaacgttcaagtgattaaagaacgccgtggtatcacttcatttactggcgttgctaccgtaaatggcgaaatcgcttgtgaagcaaaactaatgtgtgctcgtcgttaa

SEQ ID NO: 280 - protein, 148 aa, Haemophilus influenzae
MSEQQPRVIESKEIMTLLPHRYPFLLVDRVLDFKEGEWLKAIKNISVNEPCFTGHFPGEPILPGVLILEALAQAMGILAFKTLELKGGELFYFAGIDEARFKRPVLPGDQMELNVQVIKERRGITSFTGVATVNGEIACEAKLMCARR

SEQ ID NO: 281 - DNA, 447 bp, Haemophilus influenzae
  CDS (1)..(447): transl_table=11
gtgtcagaacaacaaccaaaagtgatcgaatcaaaagaaattatgactttattaccacatcgctatccatttttattagtggatcgcgtattggattttaaagaaggcgaatggttaaaagcgattaaaaatatcagcgtcaatgagccttgtttcacaggccacttcccaggcgaacccattttaccgggcgttttaattttagaagctttggcacaagcaatgggcattttagcctttaaaactcacgaattaaaaggcggcgaactattctactttgcaggtattgatgaagcgcgctttaaacgcccagtattaccgggagatcaaatggaattaaacgttcaagtgattaaaaaacgccgtggtattactgcatttactggcgttgccaccgtaaacggcgaaatcgcttgtgaagcaaaactaatgtgtgctcgtcgttaa

SEQ ID NO: 282 - protein, 148 aa, Haemophilus influenzae
MSEQQPKVIESKEIMTLLPHRYPFLLVDRVLDFKEGEWLKAIKNISVNEPCFTGHFPGEPILPGVLILEALAQAMGILAFKTHELKGGELFYFAGIDEARFKRPVLPGDQMELNVQVIKKRRGITAFTGVATVNGEIACEAKLMCARR

SEQ ID NO: 283 - DNA, 456 bp, Idiomarina loihiensis
  CDS (1)..(456): transl_table=11
ttgaaaattacggaatcaggttttgatattcagggcgtactagatttactgcctcatcgttatccgtttttattaatagacagagttatagaaacaaactctaaagactcgttacacgcgataaaaaacgtgacttttaacgagcccatgttcaatggacattttccggcaaagcctattttcccgggagtgttgttgcttgaagctatagctcaggcctgtggcttattaggttttaaaattacagaaagcaaaaagaatgcaaacgatttgtacctttttgccggtattgataatgcccgctttaaacgtcaggttatcccgggggacactgttgatttctttgttactttcgaaaaagaacgccgtggtatctggaaatttactggtcgcgcggaagttgacggtgacgttgcctgtactgctgaaattatttgtgcaagaagagaagtttaa

SEQ ID NO: 284 - protein, 151 aa, Idiomarina loihiensis
MKITESGFDIQGVLDLLPHRYPFLLIDRVIETNSKDSLHAIKNVTFNEPMFNGHFPAKPIFPGVLLLEAIAQACGLLGFKITESKKNANDLYLFAGIDNARFKRQVIPGDTVDFFVTFEKERRGIWKFTGRAEVDGDVACTAEIICARREV

SEQ ID NO: 285 - DNA, 453 bp, Legionella pneumophila subsp
  CDS (1)..(453): transl_table=11
atgaacgaatcgatagatataaatcaaatttttactttgttaccacaccgctatccatttattctggttgatagagtgatagattacaaagtcatggaatatttgattgcaattaagaatgtgactattaatgagaacttctttaccggacattttccaggaaatcctattatgcctggagtattaatgcttgaggctttagctcaggcttgtgccattttagccagtttatctcgtcaacccaaagaaggacatgagtttttgcattattttgccggtattgacaatgctcggttcaagcaagtagtgactcctggggaccaattgcgattagaggtgagattggccggacaaaaaagagatttttggcgtatgcacggagaagcttatattggtgataaattggcttgttccgcagacttattaagcgcagcaaaggaaattaaaaagtga

SEQ ID NO: 286 - protein, 150 aa, Legionella pneumophila subsp
MNESIDINQIFTLLPHRYPFILVDRVIDYKVMEYLIAIKNVTINENFFTGHFPGNPIMPGVLMLEALAQACAILASLSRQPKEGHEFLHYFAGIDNARFKQVVTPGDQLRLEVRLAGQKRDFWRMHGEAYIGDKLACSADLLSAAKEIKK

SEQ ID NO: 287 - DNA, 435 bp, Listeria innocua
  CDS (1)..(435): transl_table=11
atgttagatattaagaaaatcaaagaaattttacctcatcgttatccatttttattagtggatagagttatttctgttgaagaaggaaaaaaagtaactgctataaagaatgtaacagctaatgaagaattctttaatggccattttccggagtatcctgtaatgccgggtgtcctaattgtagaagcacttgctcaaacaagtgggattgcaatgatgcaaagtgaagctaataaaggcaaaattggtttgtttgcgggaattgatggatgtcgctttaaacgtcaagttgtgccaggtgatcaactcttacttgaagcagaaatcactcgaatgagaggcgctattgccaaggccaaagttaaggctacagtagaaggcgatttggtttgtgaagcggaaattatgttcgctttatcagatttaccacaatag

SEQ ID NO: 288 - protein, 144 aa, Listeria innocua
MLDIKKIKEILPHRYPFLLVDRVISVEEGKKVTAIKNVTANEEFFNGHFPEYPVMPGVLIVEALAQTSGIAMMQSEANKGKIGLFAGIDGCRFKRQVVPGDQLLLEAEITRMRGAIAKAKVKATVEGDLVCEAEIMFALSDLPQ

SEQ ID NO: 289 - DNA, 435 bp, Listeria monocytogenes serotype 4b
  CDS (1)..(435): transl_table=11
atgttagatattaagaaaatcaaagagattttgcctcatcgttatccatttttgttagtagatagagttatttctgttgaagaaggcaaaaaagttaccgctattaagaatgtaacagcaaatgaagaattttttaacgggcactttcctgagtatcctgtaatgccaggagttttaatagtggaagctctagcgcaaactagtggaattgcaatgatgcagagtgaagcaaataaaggtaaaattggtttatttgctggaattgatggttgccgatttaaacgtcaagttgttccgggggaccaactcttgcttgaggctgaaataactcggatgaggggcgcgattgcaaaagcaaaagtcaaagcaactgtagaaggcgatttggtttgtgaagctgaaattatgtttgccttatcagacctacctaaataa

SEQ ID NO: 290 - protein, 144 aa, Listeria monocytogenes serotype 4b
MLDIKKIKEILPHRYPFLLVDRVISVEEGKKVTAIKNVTANEEFFNGHFPEYPVMPGVLIVEALAQTSGIAMMQSEANKGKIGLFAGIDGCRFKRQVVPGDQLLLEAEITRMRGAIAKAKVKATVEGDLVCEAEIMFALSDLPK

SEQ ID NO: 291 - DNA, 453 bp, Mannheimia succiniciproducens
  CDS (1)..(453): transl_table=11
gtgacaacagaaaatagaccagcaaaaattattgaagcgcatgaaattatgacattattaccacatcgttatccgtttcttttagtggatcgcgttgttgattttgaagaaggtcagtggttaaaagcatataaaaatatcagtgtaaatgaaccttgttttaccggtcattttcctggtcagccgattttgcctggtgtattaattcttgaagcgttagcccaatctatggggcttttggcatttaaaacccatgaaattaaaggcggtgaattattttatttcgccggtattgatgatgcgcgttttaaacgcccggtattacccggagatcgtttagagctatttgtggaagtaattaaagaacgtcgcggcatcacctcttttactggtgttgccagcgtagatggtgaagtggcttgtgaagcaaaattaatgtgtgctcgtagataa

SEQ ID NO: 292 - protein, 150 aa, Mannheimia succiniciproducens
MTTENRPAKIIEAHEIMTLLPHRYPFLLVDRVVDFEEGQWLKAYKNISVNEPCFTGHFPGQPILPGVLILEALAQSMGLLAFKTHEIKGGELFYFAGIDDARFKRPVLPGDRLELFVEVIKERRGITSFTGVASVDGEVACEAKLMCARR

SEQ ID NO: 293 - DNA, 441 bp, Methylococcus capsulatus
  CDS (1)..(441): transl_table=11
ttggatattcaagcgatcaaggaatttttgcctcatcgttacccgtttcttctggtcgatcgagtgctggagtgcgagcccgggaagcggctgctcgccatcaaaaacgtcacctataacgagcctttctttcagggacatttcccgcgtgtgccgatcatgccgggggtgctgatcatcgaggcgctggcccagacgactggcctgctcgcctcggagacggcgcccgacgtgctcggaaaaggggccacttactacttggtcgggctcgacaaggtgcgtttcaagcggcctgtcgtgccgggcgatcagcttcgccttgaagcgacgtatttgcgccataaacgcaacatctgggcattcgcctgtcgtgccgacgtcgaaggcgagttcgtggccagtgccgagatcatgtgcgcagctgcggagcagggatcttga

SEQ ID NO: 294 - protein, 146 aa, Methylococcus capsulatus
MDIQAIKEFLPHRYPFLLVDRVLECEPGKRLLAIKNVTYNEPFFQGHFPRVPIMPGVLIIEALAQTTGLLASETAPDVLGKGATYYLVGLDKVRFKRPVVPGDQLRLEATYLRHKRNIWAFACRADVEGEFVASAEIMCAAAEQGS

SEQ ID NO: 295 - DNA, 450 bp, Neisseria gonorrhoeae
  CDS (1)..(450): transl_table=11
atggacgtacaactccccatcgaagccaaagacatccaaaaactcatcccccaccgctacccgtttctccagctcgaccgcattaccgccttcgagccgatgaaaaccctgaccgccatcaaaaacgtaaccataaacgaaccccaattccaaggccatttccccgacctgcccgttatgcccggcgtactcatcatcgaagcgatggcgcaggcgtgcggcacgttggcgattttgagcgaaggcgggcgcaaggaaaacgaatttttcttcttcgccggcatagacgaagcccgtttcaaacgccaagtcatccccggcgaccaactcgtctttgaagtcgaactcctgaccagccggcgcggcatcggcaaattcaacgccgttgccaaagtggacggacaagtcgccgtcgaagccgtgattatgtgcgccaaacgcgtggtttga

SEQ ID NO: 296 - protein, 149 aa, Neisseria gonorrhoeae
MDVQLPIEAKDIQKLIPHRYPFLQLDRITAFEPMKTLTAIKNVTINEPQFQGHFPDLPVMPGVLIIEAMAQACGTLAILSEGGRKENEFFFFAGIDEARFKRQVIPGDQLVFEVELLTSRRGIGKFNAVAKVDGQVAVEAVIMCAKRVV

SEQ ID NO: 297 - DNA, 450 bp, Neisseria meningitidis serogroup B
  CDS (1)..(450): transl_table=11
atggacgtacaactccccatcgaagccaaagacatccaaaaactcatcccccaccgctatccgtttctccagctcgaccgcatcaccgccttcgagccgatgaaaaccctgaccgcgattaaaaacgtcaccataaacgaaccccagttccaaggccatttccccgacctgcccgtgatgcccggcgtactcatcatcgaagcgatggcgcaggcgtgcggcacgttggcgattttgagcgaaggcgggcgcaaagaaaacgaattcttcttcttcgccggcatagacgaagcccgtttcaaacgccaagtcatccccggcgaccaactcgtctttgaagtcgagctgctgaccagccggcgcggcatcggcaaattcaacgccgttgccaaagtggacgggcaagttgccgtcgaagccatcatcatgtgtgccaaacgcgtggtttga

SEQ ID NO: 298 - protein, 149 aa, Neisseria meningitidis serogroup B
MDVQLPIEAKDIQKLIPHRYPFLQLDRITAFEPMKTLTAIKNVTINEPQFQGHFPDLPVMPGVLIIEAMAQACGTLAILSEGGRKENEFFFFAGIDEARFKRQVIPGDQLVFEVELLTSRRGIGKFNAVAKVDGQVAVEAIIMCAKRVV

SEQ ID NO: 299 - DNA, 462 bp, Nitrosomonas europaea
  CDS (1)..(462): transl_table=11
atgaaacagggagatagacaaaccgtgatggatattcatgaaatactgaaatacctgccgcatcgttatccattgattctggttgaccgggtggtttccctggaatcaggtaaacggattcatgcatacaagaatgtttccatcaatgaaccctatttttccggacatttcccccatcatcccgtcatgccgggcgtgctgatcattgaggcactggcccaggcagccgccttactgaccattcggtcggagaacatggaaaaggataatgggcaggtgtactattttgtgggtatcgacgcggtacggttcaagaaaccggtcatcgcaggggatcaactggtattgaaggtcgaaatcacccgccagctcaaaggtatctggaaatatgctgcctgtgctgaagtggatggccaggtggtcaccgaagcgcaactgatgtgtactgcccgggcaatctga

SEQ ID NO: 300 - protein, 153 aa, Nitrosomonas europaea
MKQGDRQTVMDIHEILKYLPHRYPLILVDRVVSLESGKRIHAYKNVSINEPYFSGHFPHHPVMPGVLIIEALAQAAALLTIRSENMEKDNGQVYYFVGIDAVRFKKPVIAGDQLVLKVEITRQLKGIWKYAACAEVDGQVVTEAQLMCTARAI

SEQ ID NO: 301 - DNA, 423 bp, Oceanobacillus iheyensis
  CDS (1)..(423): transl_table=11
atgatggacgtggaacaagttaaagaaatcattccacaccgttatccatttttattagtggataaagtggtagaaatacaagaaggcgaaaaagtgactgcattaaaaaatgtatcggtaaatgaaccatttttccaggggcattttccagagtatcctgtgatgccaggtgtactaattttggaagctcttgcgcaaacaggagcaattgctgttttaaatatagaggagaataaagggaaaattggctttcttgcaggtgttgacaaatgccgatttaaacgtcaagtaaaacccggagaccaattaaatttacaagtagaaattataagaatgaagggtccaatcggaaaaggaaaaggaattgcgactgtagatggtgaagtagcatgcgaggctgaaattacctttgctatcaaataa

SEQ ID NO: 302 - protein, 140 aa, Oceanobacillus iheyensis
MMDVEQVKEIIPHRYPFLLVDKVVEIQEGEKVTALKNVSVNEPFFQGHFPEYPVMPGVLILEALAQTGAIAVLNIEENKGKIGFLAGVDKCRFKRQVKPGDQLNLQVEIIRMKGPIGKGKGIATVDGEVACEAEITFAIK

SEQ ID NO: 303 - DNA, 459 bp, Pasteurella multocida
  CDS (1)..(459): transl_table=11
gtgacaactgaaactaccacaacaaaaatcattgaagcaaatgaaattatgaaattgcttcctcaccgttatccttttttattagtggatcgtgtggtggattatgaagaaggtaaatggcttaaagctgtaaaaaatattagcgtaaatgagccttgctttacgggacatttcccagaacaaccgatttttccgggtgtgttgattttggaagccatggcacaagcgacgggggtgctcgcctgtaaaacttaccgtcaattagaaaatgaaatttattattttgctgcaattgataatgcgcgctttaaacgtcctgtgttgcctggtgatcaaatggtgttagaagttcacttcttgaaagagcgtcgcggtattacgcgtttcactggtgtggcaaccgtagatggtcaagtggtgtgcgaagcagaattaatgtgtgctcgtcgtcccgcataa

SEQ ID NO: 304 - protein, 152 aa, Pasteurella multocida
MTTETTTTKIIEANEIMKLLPHRYPFLLVDRVVDYEEGKWLKAVKNISVNEPCFTGHFPEQPIFPGVLILEAMAQATGVLACKTYRQLENEIYYFAAIDNARFKRPVLPGDQMVLEVHFLKERRGITRFTGVATVDGQVVCEAELMCARRPA

SEQ ID NO: 305 - DNA, 453 bp, Photorhabdus luminescens subsp
  CDS (1)..(453): transl_table=11
atgagtgataatcatactctgcacattgaagaaattttagatctacttccacatcgttatccgtttttattagtggatcgcgtgcttgattttgaggaaggtaaattcttacgtgcagtaaaaaacgtatcttttaacgaacccttctttcaggggcattttcccggcaaacctattttcccaggtgttctgatccttgaagctatggcacaggccaccggaatcctggcatttaggagtgtgggcaagctagagccaaatgagctctattattttgccgctatcgatggtgcccgctttaaacgcccggtagtgcctggggatcaaatgatattagaagtagaatttattaaggagcgtcgaggggttgcgcgttgtagaggcgtagcgaaagtcgatggagaaatagcttgcgaagcagaaatgatgtgtgctcgccgtcgtgaggtttag

SEQ ID NO: 306 - protein, 150 aa, Photorhabdus luminescens subsp
MSDNHTLHIEEILDLLPHRYPFLLVDRVLDFEEGKFLRAVKNVSFNEPFFQGHFPGKPIFPGVLILEAMAQATGILAFRSVGKLEPNELYYFAAIDGARFKRPVVPGDQMILEVEFIKERRGVARCRGVAKVDGEIACEAEMMCARRREV

SEQ ID NO: 307 - DNA, 453 bp, Photobacterium profundum
  CDS (1)..(453): transl_table=11
ttgacgagcgaaaagaaaacgttaaatatcacagaaattcaggcgcttttaccgcaccgttacccatttttaatgattgatcgtgtaacggattacgaagaaggtcaaacgttaacagcatataaaaatgtctcaataaacgagcctttatttactggccattttcctaagatgcctatttttcctggcgtgatgattcttgaagcaatggctcaagctactggtttattagcttttaaaagctttggtgcaccctctgaaaatgagctgtattactttgcaagtattgataaagcgaagttccgtaaacctgttgttcctggcgaccagcttgttttaaacgttgagtttataaaagagcgccgtggtattgctctatttaatggcaccgcaaaagttgacggtgaagttgtttgctctgctgagcttaaatgcgcaagacgagaattctaa

SEQ ID NO: 308 - protein, 150 aa, Photobacterium profundum
MTSEKKTLNITEIQALLPHRYPFLMIDRVTDYEEGQTLTAYKNVSINEPLFTGHFPKMPIFPGVMILEAMAQATGLLAFKSFGAPSENELYYFASIDKAKFRKPVVPGDQLVLNVEFIKERRGIALFNGTAKVDGEVVCSAELKCARREF

SEQ ID NO: 309 - DNA, 456 bp, Prochlorococcus marinus
  CDS (1)..(456): transl_table=11
ttgactaattccccttctagccctgttgttttaacaaatgaggagataatgggacttttgcctcatagatatccttttgcattagtcgaccgtgttgtggaatatgaaccgggtaaaagtgctactggtataaagaatgtcacgattaatgagcctcattttcaagggcatttcccaggaagaccattgatgcctggtgttttaatcgttgaggccatggctcaagttggtggattaattgtcaagcagatacctgatttacctaaagggctttttgtttttgcaggaatagatagtgttcgatttcgtcgtccagtagtgcctggcgatcaattgctaataaattgtgaattaataagtatcaaaagacaacgctttggaaaagttaagggagaggccaaagttgatggcaatttagtttgttcaggtgaattgatgttttctttagtggattaa

SEQ ID NO: 310 - protein, 151 aa, Prochlorococcus marinus
MTNSPSSPVVLTNEEIMGLLPHRYPFALVDRVVEYEPGKSATGIKNVTINEPHFQGHFPGRPLMPGVLIVEAMAQVGGLIVKQIPDLPKGLFVFAGIDSVRFRRPVVPGDQLLINCELISIKRQRFGKVKGEAKVDGNLVCSGELMFSLVD

SEQ ID NO: 311 - DNA, 429 bp, Prochlorococcus marinus
  CDS (1)..(429): transl_table=11
gtgttgacaagtgagcagatcatggggctgctgcctcatcgttatccgtttgctctggttgatcgtgttgtgctccatgaacctggccagcgggctgttgcgatcaaaaatgtgaccctcaatgaacctcagtttcagggtcatttccctggtcgtcctttgatgcctggggtcttgattgttgaggcgatggcccaggtgggtggtttgatcgtggcccagatgccagatctgcccaaggggttattcgtgtttgcaggtatcgatgcagttcgtttccgccgtccggtggtgccaggagatcagctcacgattagctgtgaactgcttagcttgaagcggcagcgctttggcaaggtcaggggtgaagccagggtggagggccagctggtttgctctggtgagttgatgttttccttggtggactga

SEQ ID NO: 312 - protein, 142 aa, Prochlorococcus marinus
MLTSEQIMGLLPHRYPFALVDRVVLHEPGQRAVAIKNVTLNEPQFQGHFPGRPLMPGVLIVEAMAQVGGLIVAQMPDLPKGLFVFAGIDAVRFRRPVVPGDQLTISCELLSLKRQRFGKVRGEARVEGQLVCSGELMFSLVD

SEQ ID NO: 313 - DNA, 459 bp, Prochlorococcus marinus subsp
  CDS (1)..(459): transl_table=11
ttggaacaacaattatcgactgaaaataatcaactatcttctgaggaaatattaggtcttttgcctcatagatttcctttcgctcttatagatagagttatagaacatgtcccaggcaaaaaagctgttgcattgaaaaatgtgactataaatgagcctcaatttcagggccatttcccagagagacctttaatgcctggggtgcttattgttgaagcaatggctcaagtagggggaataatcgtaactcaaatgcctgaccttcccaaaggactttttgtatttgcaggtattaataatgtcaaatttagaaggccagtagtacctggagaccagttagtaattacttgcgagttattaagtataaagagacaaagatttgggaaggtaaaaggtgaagctcatgttgatgggaagttggtttgctcaggcgaattaatgttttcattagttgattaa

SEQ ID NO: 314 - protein, 152 aa, Prochlorococcus marinus subsp
MEQQLSTENNQLSSEEILGLLPHRFPFALIDRVIEHVPGKKAVALKNVTINEPQFQGHFPERPLMPGVLIVEAMAQVGGIIVTQMPDLPKGLFVFAGINNVKFRRPVVPGDQLVITCELLSIKRQRFGKVKGEAHVDGKLVCSGELMFSLVD

SEQ ID NO: 315 - DNA, 441 bp, Pseudomonas syringae pv
  CDS (1)..(441): transl_table=11
atgatggacatcaaagaaattcgcgaatacctgcctcatcgttacccgttcctgctggtggaccgcgtgaccgagctggatatcgagaacaagaacattcgcgcctacaagaatgtcagcgtcaacgagccttttttcaacggccacttccccgagcatcccatcatgccgggtgtgctgatcatcgaagctatggcgcaggctgccggtattcttgcgttcaagatgctcgactccaagccttcagacggtacgctctattatttcgtgggttctgacaaactgcgtttccgtcaaccggttctgccgggcgaccagctggttcttgaagcgaagttcctgagcagcaagcgtcagatctggaagttcgaatgcaaggctacagttgatggcaaggcggtatgctctgccgaaatcatctgtgcggaacgtaaactatga

SEQ ID NO: 316 - protein, 146 aa, Pseudomonas syringae pv
MMDIKEIREYLPHRYPFLLVDRVTELDIENKNIRAYKNVSVNEPFFNGHFPEHPIMPGVLIIEAMAQAAGILAFKMLDSKPSDGTLYYFVGSDKLRFRQPVLPGDQLVLEAKFLSSKRQIWKFECKATVDGKAVCSAEIICAERKL

SEQ ID NO: 317 - DNA, 441 bp, Pseudomonas aeruginosa
  CDS (1)..(441): transl_table=11
atgatggacatcaacgagattcgcgaatacctgcctcatcgctatcctttcctgctggtggatcgggtggtagagctggacatcgagggcaagcgcattcgcgcctacaagaatgtcagtatcaatgagccgttcttcaacggacatttccccgagcacccgatcatgccgggcgtgctgatcatcgaggcgatggcccaggcggccggtatcctcggtttcaagatgctcgacgtgaagcccgccgacggcaccctttactacttcgtcggttcggacaagctgcgcttccgccagccggtcctgccgggcgaccaactgcaactgcacgccaagttcatcagcgtgaagcgcagcatctggaaattcgactgccacgctaccgtcgacgacaagccggtatgctcggctgaaatcatctgtgcggaacgcaaactatga

SEQ ID NO: 318 - protein, 146 aa, Pseudomonas aeruginosa
MMDINEIREYLPHRYPFLLVDRVVELDIEGKRIRAYKNVSINEPFFNGHFPEHPIMPGVLIIEAMAQAAGILGFKMLDVKPADGTLYYFVGSDKLRFRQPVLPGDQLQLHAKFISVKRSIWKFDCHATVDDKPVCSAEIICAERKL

SEQ ID NO: 319 - DNA, 441 bp, Pseudomonas fluorescens
  CDS (1)..(441): transl_table=11
atgatggacatcaacgagattcgcgaatacttgcctcaccgttaccctttcctgttggtggatcgggtagtggacctggatgttgaaggcaagtgcattcgtgcctacaagaatgtcagcatcaatgaaccgttcttcaatggtcacttccctgcgcacccgatcatgccgggcgtgctgatcatcgaggccatggctcaggctgcgggcattctcggtttcaagatgctcgacgtgaagcccgccgacggcaccctctattacttcgtcggttccgacaagctgcgcttccgccagccggtgctgccgggcgaccagttgatccttgaagccaagttcatcagctgcaagcgccagatctggaagttcgaatgccaggcttcggtcgacggcaagccggtgtgctctgccgagatcatctgtgcggaacgcaaactatga

SEQ ID NO: 320 - protein, 146 aa, Pseudomonas fluorescens
MMDINEIREYLPHRYPFLLVDRVVDLDVEGKCIRAYKNVSINEPFFNGHFPAHPIMPGVLIIEAMAQAAGILGFKMLDVKPADGTLYYFVGSDKLRFRQPVLPGDQLILEAKFISCKRQIWKFECQASVDGKPVCSAEIICAERKL

SEQ ID NO: 321 - DNA, 441 bp, Pseudomonas fluorescens
  CDS (1)..(441): transl_table=11
atgatggacatcaacgagattcgcgaatacctgcctcaccgttacccgttcctgctggtggatcgggtagtggagctggatacggaaggcaagcgcattcgcgcctacaagaatgtcagcatcaacgagccgttcttcaacggtcacttcccggcgcacccgatcatgccgggcgtgctgatcatcgaagccatggctcaggctgccgggatcctcggtttcaagatgcttgacgtgaaaccggccgacggcaccctttattacttcgttggctccgacaaactgcgtttccgccagccagtgctgccgggcgatcagttgatcctcgaagccaagttcatcagttgcaagcgtcagatctggaagttcgaatgccaggcttcggtcgatggcaaaccggtctgctcggctgaaatcatctgtgcggaacgcaagctatga

SEQ ID NO: 322 - protein, 146 aa, Pseudomonas fluorescens
MMDINEIREYLPHRYPFLLVDRVVELDTEGKRIRAYKNVSINEPFFNGHFPAHPIMPGVLIIEAMAQAAGILGFKMLDVKPADGTLYYFVGSDKLRFRQPVLPGDQLILEAKFISCKRQIWKFECQASVDGKPVCSAEIICAERKL

SEQ ID NO: 323 - DNA, 441 bp, Pseudomonas putida
  CDS (1)..(441): transl_table=11
atgatggacatcaacgagattcgcgaatacctgcctcaccgctacccgttcctgctggtagaccgtgtgacggatctggacttcgaggcccagagcattcgtgcctacaagaatgtcagcatcaatgagccgtttttcaatggccacttcccggcacacccgatcatgccgggtgtcctgatcatcgaagccatggcccaggcggccggcatccttggtttcaagatgctcgatgccaagccggccgatggcaccctgtactactttgtcggttccgacaaactgcgtttccgtcagccggttctgccgggtgaccagcttgtgctggaagccaagttcctcagccgtaaaagcatgatctggaagttcgagtgccgcgcccttgtcgatggcaagccggtctgctcggcagaaatcacctgcgcggaacgctccctatga

SEQ ID NO: 324 - protein, 146 aa, Pseudomonas putida
MMDINEIREYLPHRYPFLLVDRVTDLDFEAQSIRAYKNVSINEPFFNGHFPAHPIMPGVLIIEAMAQAAGILGFKMLDAKPADGTLYYFVGSDKLRFRQPVLPGDQLVLEAKFLSRKSMIWKFECRALVDGKPVCSAEITCAERSL

SEQ ID NO: 325 - DNA, 441 bp, Pseudomonas syringae pv
  CDS (1)..(441): transl_table=11
atgatggacatcaacgaaattcgcgaatacctgcctcatcgttacccgttcctgctggtggaccgcgtgaccgagctggatatcgagaacaagaacattcgcgcctacaagaatgtcagcgtcaacgagcctttcttcaacggtcacttcccccagcatccaatcatgccgggcgttctgatcattgaggccatggctcaggctgcgggtattcttgcgttcaagatgctcgactccaagccatccgacggcacgctctattatttcgtaggttcggacaagctgcgcttccgccaaccggtttttccgggtgacaaactggttcttgaagcaacgtttctgagcagcaaacgccagatctggaagtttgagtgcaaggccaccgttgatggtaaagcggtatgctctgccgaaatcatctgtgcggaacgcaagctatga

SEQ ID NO: 326 - protein, 146 aa, Pseudomonas syringae pv
MMDINEIREYLPHRYPFLLVDRVTELDIENKNIRAYKNVSVNEPFFNGHFPQHPIMPGVLIIEAMAQAAGILAFKMLDSKPSDGTLYYFVGSDKLRFRQPVFPGDKLVLEATFLSSKRQIWKFECKATVDGKAVCSAEIICAERKL

SEQ ID NO: 327 - DNA, 453 bp, Ralstonia eutropha
  CDS (1)..(453): transl_table=11
atgaccgccgccgagatcgacatccgccagattctgaaactgctgccgcatcgctatccgatgctgctggtggaccgtgtgctcgaattcgaaccgcagaagcgaatcaagacgctgaagaacgtcacgatcaacgagccgttcttccagggacattttcccggccagccggtgatgcctggcgtgatgatcctggaagcgctggcccagtccgccggtctgctgaccttcggcgccgacatggagcgcaaggaaggcgcgctgtattacttcgtcggcatcgacggcgcgcgcttcaagcaggtcgtctatccgggggaccaactgcacatgaacgtgaccgtggagcgctatatccgcggcatctggaagttcaaggcgtttgccacagtggacgagaaggtcgcgtgtgaagcggaactgatgtgcactgtcaagcaggctgacgcctga

SEQ ID NO: 328 - protein, 150 aa, Ralstonia eutropha
MTAAEIDIRQILKLLPHRYPMLLVDRVLEFEPQKRIKTLKNVTINEPFFQGHFPGQPVMPGVMILEALAQSAGLLTFGADMERKEGALYYFVGIDGARFKQVVYPGDQLHMNVTVERYIRGIWKFKAFATVDEKVACEAELMCTVKQADA

SEQ ID NO: 329 - DNA, 495 bp, Ralstonia solanacearum
  CDS (1)..(495): transl_table=11
atgaccgaaccctctgccgcgacgacgagcctcgtcagcgatttcaacatcaagaagattctcgaactgctgccgcaccgctatccgatgctgctggtcgatcgcgtgctcgagatggagccgcgcaagcgcatcaaggcgatcaagaacgtcaccttcaacgagccgttcttcaacggccatttcccgggccacccggtgatgccgggcgtgctgatgctcgaagcgctggcccagaccgccgcgctgctgaccttcggcgagtccaatcacaagcgccaggaaaaccagctctacctgttcgtcagcatcgatggcgcgcgcttcaagcgccaggtcacgccgggcgatcagctggtgctgaacgccgagctgctgcgctccaagagcggcatgtggaagttcaaggtgttcgcgaccgtggacgatgaagtcgcggccgaggctgagatcatgtgtgccgtgcgcgaagacaagtccaagggcgacgcatga

SEQ ID NO: 330 - protein, 164 aa, Ralstonia solanacearum
MTEPSAATTSLVSDFNIKKILELLPHRYPMLLVDRVLEMEPRKRIKAIKNVTFNEPFFNGHFPGHPVMPGVLMLEALAQTAALLTFGESNHKRQENQLYLFVSIDGARFKRQVTPGDQLVLNAELLRSKSGMWKFKVFATVDDEVAAEAEIMCAVREDKSKGDA

SEQ ID NO: 331 - DNA, 438 bp, Saccharophagus degradans
  CDS (1)..(438): transl_table=11
atgatggattcagtacaaattcgtaaataccttccacaccgttacccgttcttgttaatagatcgagttgttgagctggtagaaggtgattacatcttggcctataaaaacattactattaacgaagaggtttttcagggccacttccccaattaccccgtgtttcctggggtgatgctaatagaagccatggcacaggcctgtggcgtgttgggtttcaaaaccatggataaaacccctgatgatggttctatctatttgtttgctggtattgataacgtgcgctttaagcgccaagtcattcctggcgatcgcgtgttttttaactgcaaaaaaatatccgataagcgtggtatttggaagttcgagtgtgttgctactgttgatgatcaactggtaactagcgctactatcatgtgtgccgaccgcagtatttaa

SEQ ID NO: 332 - protein, 145 aa, Saccharophagus degradans
MMDSVQIRKYLPHRYPFLLIDRVVELVEGDYILAYKNITINEEVFQGHFPNYPVFPGVMLIEAMAQACGVLGFKTMDKTPDDGSIYLFAGIDNVRFKRQVIPGDRVFFNCKKISDKRGIWKFECVATVDDQLVTSATIMCADRSI

SEQ ID NO: 333 - DNA, 465 bp, Shewanella oneidensis
  CDS (1)..(465): transl_table=11
gtgtctaatcaaatgaacactatggatattacggagatccttaagtatcttccccatagatatccattcctattaatcgatcgcgttttagatttcaccccaggtgagagtctccatgcgattaaaaacgtgacgattaatgagcccttctttcaggggcatttcccgatccagcctgtgatgcctggcgtgctgattttagaagccatggcacaggccactggtctacttgcttttaagaccatgagcgacgatgtgccacctcctggtgtgttgtattattttgcgggtattgataacgcgcgttttagacgtgtggttgagcctggtgatcaaatccattttgaagttaaaatgattaaagagcgccgcgggattggcgttttctatggtgaggccaaagtggatggtgaagtggtttgttccgctgaaatcatgtgtgcccgcagagagattaatcagtga

SEQ ID NO: 334 - protein, 154 aa, Shewanella oneidensis
MSNQMNTMDITEILKYLPHRYPFLLIDRVLDFTPGESLHAIKNVTINEPFFQGHFPIQPVMPGVLILEAMAQATGLLAFKTMSDDVPPPGVLYYFAGIDNARFRRVVEPGDQIHFEVKMIKERRGIGVFYGEAKVDGEVVCSAEIMCARREINQ

SEQ ID NO: 335 - DNA, 429 bp, Symbiobacterium thermophilum
  CDS (1)..(429): transl_table=11
atggagatcatcccgcaccgccacccgttcctgctgatcgaccgggtgctggaactggagccgggcaggcgggtggtggcggtgaagaacgtgtcgatgaacgagccggtctttcaggggcattaccccggcaacccgatctttcccggcgtgctgatcctggaggccatggcgcaggcgggggcggtggccgtgctctcgcagcccgagttcgccggcaaggtgccgcttttcgccgggatcgacgacgcgcgcttccgccgtccggtgctgcccggcgaccagctgcgcctcgaggtggagatggtcgcgatgcggcgcgggctcggcgtcggcaaggggatggcctacgtgggcgacgagctgaaggcggaggccacgctgaagttcgccctcgtcgacgcggccacgccggaaccggcccggtag

SEQ ID NO: 336 - protein, 142 aa, Symbiobacterium thermophilum
MEIIPHRHPFLLIDRVLELEPGRRVVAVKNVSMNEPVFQGHYPGNPIFPGVLILEAMAQAGAVAVLSQPEFAGKVPLFAGIDDARFRRPVLPGDQLRLEVEMVAMRRGLGVGKGMAYVGDELKAEATLKFALVDAATPEPAR

SEQ ID NO: 337 - DNA, 462 bp, Synechococcus elongatus
  CDS (1)..(462): transl_table=11
atgccaacgttgactgattccccaccaaccactgtactgacggtcactgagctacagcagttgctcccccaccgctacccttttttgctggtggatcggatcattgactatgtccccgaaaagtatgctgtggggctaaaaaacgtcaccatcaacgaacccttttttcaagggcactttccgggtcgcccgatcatgccgggggtgctcattgtggaagcccttgcccaagtgggcggggttgtgctgatgcagatgaactgggcaaaggataaactttctgtgttcgcgggcattgataaggtgcgctttcgccgtccagtcgtccccggagatcagttgatcctgcgggcggagcttcttgttgtcaaacaacagcgcattggaaaaatgcaaggacgggctgaggtgaatggtcaattggtctgtgagggcgagatgatgttctcgctggtggactag

SEQ ID NO: 338 - protein, 153 aa, Synechococcus elongatus
MPTLTDSPPTTVLTVTELQQLLPHRYPFLLVDRIIDYVPEKYAVGLKNVTINEPFFQGHFPGRPIMPGVLIVEALAQVGGVVLMQMNWAKDKLSVFAGIDKVRFRRPVVPGDQLILRAELLVVKQQRIGKMQGRAEVNGQLVCEGEMMFSLVD

SEQ ID NO: 339 - DNA, 471 bp, Synechococcus sp
  CDS (1)..(471): transl_table=11
gtgactgattcccccgcctcggacgccgctcagtcctccgtggtgctgaccagtgaacagatcgctggactgctgccccatcgctatccgtttgctctggtggaccgggtcatcgcccatgagcctggggtgtcggcgaccgggatcaagaacgtgacggtcaatgagccgcagtttcaaggccatttccctggacgcccgttgatgccgggggtgctgattgttgaggcgatggctcaggtcggggggttgatcgtgacccagatgcccgatctaccgaagggtctgttcgtttttgccgggattgacggggtacgcttccgccgccccgtggttcctggagatcagctggtgatccactgcgaactgctcagcctcaagcgcaaacgcttcggcaaggtgaaggctgaagccaaagttgatggcgagctggtctgttccggcgagctgatgttctccctggtggactga

SEQ ID NO: 340 - protein, 156 aa, Synechococcus sp
MTDSPASDAAQSSVVLTSEQIAGLLPHRYPFALVDRVIAHEPGVSATGIKNVTVNEPQFQGHFPGRPLMPGVLIVEAMAQVGGLIVTQMPDLPKGLFVFAGIDGVRFRRPVVPGDQLVIHCELLSLKRKRFGKVKAEAKVDGELVCSGELMFSLVD

SEQ ID NO: 341 - DNA, 456 bp, Synechococcus sp
  CDS (1)..(456): transl_table=11
gtgactgaatccaccacctcagatgtcgtgctgaccagcgagcagatcgccggtttgcttccgcaccgttaccccttcgcgctggtggatcgggtcatcgcccatgatcccggggtttcggccacggcgatcaaaaacgtgaccatgaacgagccccagttccaggggcatttccccgagcgtccgctgatgcccggggtgctgattgtcgaggcgatggcgcaggtgggtggtctgatcgtcacccagatgccggatctgcccaagggtctgttcgtttttgccggcatcgacggggtacgcttccggcgccctgtggttcccggagatcagctggtgatccgctgtgaactgctcagcctcaagcgcaaacgcttcggcaaggtcaaggctgaggccacagtggatggcgatctggcctgctccggcgaattgatgttctccctggtggactga

SEQ ID NO: 342 - protein, 151 aa, Synechococcus sp
MTESTTSDVVLTSEQIAGLLPHRYPFALVDRVIAHDPGVSATAIKNVTMNEPQFQGHFPERPLMPGVLIVEAMAQVGGLIVTQMPDLPKGLFVFAGIDGVRFRRPVVPGDQLVIRCELLSLKRKRFGKVKAEATVDGDLACSGELMFSLVD

SEQ ID NO: 343 - DNA, 429 bp, Thermus thermophilus
  CDS (1)..(429): transl_table=11
gtggacatccgggagatcctcaaggtcctgccccaccgctacccctttctcctcgtggaccgggtgctggaggcggacgagaggcgcttcaaggccctcaagaacgtgaccttcaacgagccccacttccaggggcacttccccggccaccccgtcatgcccggggtgctgatcctggaggccatggcccaggcggccgtgggggcgctggtgcgccagccgggctttccccaagggggcctcgccttcctcgccggggtggagggggcccggttccggcggcccgtctaccctggggacaccctgatcctcgagggggagctcctcgccttccgccggggcgtgggcaaggtggcggtgcgggccctggtggagggggaggagcgggcgagcgccaccctgaccttcgtcctccagggggcctcctga

SEQ ID NO: 344 - protein, 142 aa, Thermus thermophilus
MDIREILKVLPHRYPFLLVDRVLEADERRFKALKNVTFNEPHFQGHFPGHPVMPGVLILEAMAQAAVGALVRQPGFPQGGLAFLAGVEGARFRRPVYPGDTLILEGELLAFRRGVGKVAVRALVEGEERASATLTFVLQGAS

SEQ ID NO: 345 - DNA, 426 bp, Thermoanaerobacter tengcongensis
  CDS (1)..(426): transl_table=11
gtggaaaataaagacataagaaaaattcttccccacagatacccttttttgctagtagataggataatagagcttgaagaagggaaaagagctgtcgggataaagaatgttacatctaacgagcccttttttcaggggcattttccagacaaccccataatgccgggagttttgattgtggaagcgctggcacaggtggcagggattgctgtaatgaatgtagaagagtttaaagggaagctggggctttttgcaggcattgataaatgccgctttaaaaaagttgtgcggccgggcgaccagctcatcttagaggtctcaatagattcaattaggatggggttagtcaaagctaaaggcgttgcaaaagtgggagaggaaatcgcagctactgctgaactcatgtttgtgatggcggaggaatag

SEQ ID NO: 346 - protein, 141 aa, Thermoanaerobacter tengcongensis
MENKDIRKILPHRYPFLLVDRIIELEEGKRAVGIKNVTSNEPFFQGHFPDNPIMPGVLIVEALAQVAGIAVMNVEEFKGKLGLFAGIDKCRFKKVVRPGDQLILEVSIDSIRMGLVKAKGVAKVGEEIAATAELMFVMAEE

SEQ ID NO: 347 - DNA, 438 bp, Thiobacillus denitrificans
  CDS (1)..(438): transl_table=11
atggacatcgagcaggtgatgcagtacctgccgcatcgttaccccttcctgctggtcgacaaggtcaccgagctcgaactcggcaagcgcatcaccgcagtcaagaacgtcaccatcaacgagcctttcttcaacggccatttccccggcgcaccggtgatgcctggcgtgctgattctcgaagcgatggcgcaggcggcgggcatcctatcgttcaagaccaagaattactcgccggagcagatcggcatcatctacttcgccggcattgacggcgcgcgcttcaagaagcccgtcaaaccgggcgatcagctcgtgctcaaggccgagatcgtgcgcgaagtgcgtggcatctggaagtacaccggacgtgccgaggtcgacggcgcgctggtcgccgaggccgaattgatggcgacgctgcgcgacaaaccctga

SEQ ID NO: 348 - protein, 145 aa, Thiobacillus denitrificans
MDIEQVMQYLPHRYPFLLVDKVTELELGKRITAVKNVTINEPFFNGHFPGAPVMPGVLILEAMAQAAGILSFKTKNYSPEQIGIIYFAGIDGARFKKPVKPGDQLVLKAEIVREVRGIWKYTGRAEVDGALVAEAELMATLRDKP

SEQ ID NO: 349 - DNA, 462 bp, Vibrio cholerae
  CDS (1)..(462): transl_table=11
atgatgactttgactactgataagaaaacgatgaatatcactgaaattcaatcgcttctgcctcaccgctatccatttttactgattgatcgcgtgaccgactatgaagaaggtaagtacctgattggtttgaaaaatgtttcagtgaatgagcctcagtttacgggtcactttccacaactgccggttttccccggtgtattgattttagaagccatggctcaagccactggtctgttggcgttcaaaacctttggtgcgccaaaagagaatgaactgtactattttgccagcattgatgaagctaagttccgtaagccagtgacaccgggcgatcaactgatggttgaagttgaattccttaaagagcgtcgtggtatcgcgctgtttaacggcgtggccaaagtcgatggtgatgtggtctgttctgctcaactgaaatgcgcacgtcgagagttttaa

SEQ ID NO: 350 - protein, 153 aa, Vibrio cholerae
MMTLTTDKKTMNITEIQSLLPHRYPFLLIDRVTDYEEGKYLIGLKNVSVNEPQFTGHFPQLPVFPGVLILEAMAQATGLLAFKTFGAPKENELYYFASIDEAKFRKPVTPGDQLMVEVEFLKERRGIALFNGVAKVDGDVVCSAQLKCARREF

SEQ ID NO: 351 - DNA, 453 bp, Vibrio parahaemolyticus
  CDS (1)..(453): transl_table=11
ttgactactgaaaagaaaacgatgaacatctctgaaattcaagagctactacctcatcgctacccattcttattgatcgaccgagtgattgacttccaagaagcgaagtaccttcacgcaattaaaaatgtgtcggttaacgaacctcagttcacaggtcactttcctcaactaccagtattcccaggtgtgttgattctggaagctatggctcaggctactggcctactagcatttaaatcatttggtgcaccgacagaaaacgagttgtactactttgcgagtgtagacggcgcgaaattccgtaaacctgtggttcctggtgaccaaatggttattgaagttgaatttctaaaagagcgtcgtggcattgctgcatttagcggtgtagcaaaagttgacggcgaagtagtgtgttcagcagagctgaagtgtgctcgtcgagagttttaa

SEQ ID NO: 352 - protein, 150 aa, Vibrio parahaemolyticus
MTTEKKTMNISEIQELLPHRYPFLLIDRVIDFQEAKYLHAIKNVSVNEPQFTGHFPQLPVFPGVLILEAMAQATGLLAFKSFGAPTENELYYFASVDGAKFRKPVVPGDQMVIEVEFLKERRGIAAFSGVAKVDGEVVCSAELKCARREF

SEQ ID NO: 353 - DNA, 459 bp, Xanthomonas axonopodis pv
  CDS (1)..(459): transl_table=11
atgagccaccacgtttacgaactgccgatcgacgtcagtcagatccagacgctgctcccgcaccgttacccgtttctgctggtcgaccgcatcctcgaactcgatcttgaaaccaagtggatcgtggcgcagaagaacgtcagcatcaacgagccgttcttccagggccattttccgaaccgtccggtcatgcctggcgtgctgatcatcgaggcgctggcgcaggtcggcggcgtaatgacccagctcggcctgggccgcgatgccttgtcgcagctgttctatatggtcaaggtggacaaggcccgcttcaacaagcaggtggtgccgggcgacgtgttgatcatggaagtgcagatgaagcgcctgatccgcaacgtgggatgcttctacggcgaagccaaggtcgatggcgaagtggtggccagtgccgaggtgatgtgcgccggcgccaggtaa

SEQ ID NO: 354 - protein, 152 aa, Xanthomonas axonopodis pv
MSHHVYELPIDVSQIQTLLPHRYPFLLVDRILELDLETKWIVAQKNVSINEPFFQGHFPNRPVMPGVLIIEALAQVGGVMTQLGLGRDALSQLFYMVKVDKARFNKQVVPGDVLIMEVQMKRLIRNVGCFYGEAKVDGEVVASAEVMCAGAR

SEQ ID NO: 355 - DNA, 483 bp, Xylella fastidiosa
  CDS (1)..(483): transl_table=11
atgagcgattcacccactaccgctcacactcgtctggaattaccaatcgatatcattaaaatccaagcattgctgccacaccgctatccctttctattggtcgaccgaatactggaactagaccagaagcaaaagcgtatcgttgctcagaagaatgtgtccatcaacgaaccattctttcaaggacattttcctgaacatccagtcatgccaggcgttcttatcattgaagcacttgcgcaagccggcggcgtgatgactcaactaaaccttagccataatgggcattccagcctcttgttttatatggttagagtcgacaatgcccgcttcaacaaacaggtggtgcccggcgacatcctgatcctggatatgacgatgaaacgccggatccgcaatatgggctgctactacggcgaagcgcgggttaacggcgaagtcgtcgcttgcgctgatatcatgtgtgctggtgtcaagtcttaa

SEQ ID NO: 356 - protein, 160 aa, Xylella fastidiosa
MSDSPTTAHTRLELPIDIIKIQALLPHRYPFLLVDRILELDQKQKRIVAQKNVSINEPFFQGHFPEHPVMPGVLIIEALAQAGGVMTQLNLSHNGHSSLLFYMVRVDNARFNKQVVPGDILILDMTMKRRIRNMGCYYGEARVNGEVVACADIMCAGVKS

SEQ ID NO: 357 - DNA, 483 bp, Xylella fastidiosa
  CDS (1)..(483): transl_table=11
atgagcgattcacccactaccgctcacactcgtctggaattaccaatcgatatcattagaatccaagcattgctgccacaccgctatccctttctattggtcgaccgaatactggaactagaccagaagcaaaagcgtatcgttgctcagaaaaatgtgtccatcaacgaaccattctttcaaggacatttccctgaacatccagtcatgccaggcgttcttatcattgaagcacttgcgcaagccggcggcgtgatgacccaactaaaccttagccataatgggcattccagcctcttgttttatatggttagagtcgacaatgcccgcttcaacaaacaggtggtgcccggcgacatcctgatcctggatatgacgatgaaacgacggatccgcaatatgggctgctactacggcgaagcgcgggttaacggcgaagtcgtcgcttgcgctgatatcatgtgtgctggtgtcaagtcttaa

SEQ ID NO: 358 - protein, 160 aa, Xylella fastidiosa
MSDSPTTAHTRLELPIDIIRIQALLPHRYPFLLVDRILELDQKQKRIVAQKNVSINEPFFQGHFPEHPVMPGVLIIEALAQAGGVMTQLNLSHNGHSSLLFYMVRVDNARFNKQVVPGDILILDMTMKRRIRNMGCYYGEARVNGEVVACADIMCAGVKS

SEQ ID NO: 359 - DNA, 531 bp, Yersinia pseudotuberculosis
  CDS (1)..(531): transl_table=11
ttgactactgacactcatactctgcatattgaagagattttggatctactcccgcaccgttttccgttcttgctggtagaccgtgtccttgattttgaggaaggaaaatttctgcgtgcagtgaagaacgtctcttttaacgagccatttttccaaggccatttcccaggcaagcccatcttccctggtgtgcttatattagaagcgatggcgcaggctacagggattttggcgtttaagagccgcggtaaactggaaccgggcgagctttattactttgctggtattgatgaagcacgttttaagcgcccagtagtgcctggcgatcagatgatcatggaagttgagtttgttaaagaacgccgtggcctaacccgttttaccggtgtagctaaagtcgatggcgaaatcgtttgcactgccaccatgatgtgcgcgcgtagcaaaccagcagcacctgcagaatctgtcgttgtaaaaccagatgttgtaaaaccagatgttgtaaatcctgtcgttaaggagtcctga

SEQ ID NO: 360 - protein, 176 aa, Yersinia pseudotuberculosis
MTTDTHTLHIEEILDLLPHRFPFLLVDRVLDFEEGKFLRAVKNVSFNEPFFQGHFPGKPIFPGVLILEAMAQATGILAFKSRGKLEPGELYYFAGIDEARFKRPVVPGDQMIMEVEFVKERRGLTRFTGVAKVDGEIVCTATMMCARSKPAAPAESVVVKPDVVKPDVVNPVVKES

SEQ ID NO: 361 - DNA, 648 bp, Oryza sativa
  CDS (1)..(648)
atggagaccgcggcgatgccaagatctccgtgctgctccctcccctccgcccgtgtcctcccctcccgccttcccctcctgccccgccccgcgccggcggctctctcggccccggccgccaggccggtcgtggcccggtgcgccgccgccgccggccacgggggcgagggcgagatgcccatagagaagaggtttcctcccttcccggctgtgatggacatcaaccaaatccgcgatatcttgccgcacaggtttccattccttctggttgatagagtgattgattacaagccaggggaatatgctgttgggatcaagaatgttacaataaatgataacttcttcccagggcattttccggagagacctataatgcctggtgttcttatggtggaggcaatggcccaggttggaggtctggttatgttgcaacctgaagttggtggatctcgagagaacttcttttttgcagggattgataaagtgagatttcgtaagcctgtgattgctggagacaccttgattataaggatgactctgatcaagttgcagaagaggtttggaatcgcaaagatggaaggaaaagcatatgttggaggcgacctagtatgtgagggagagttcttgatggcaaccggatctgaataa

SEQ ID NO: 362 - protein, 215 aa, Oryza sativa
METAAMPRSPCCSLPSARVLPSRLPLLPRPAPAALSAPAARPVVARCAAAAGHGGEGEMPIEKRFPPFPAVMDINQIRDILPHRFPFLLVDRVIDYKPGEYAVGIKNVTINDNFFPGHFPERPIMPGVLMVEAMAQVGGLVMLQPEVGGSRENFFFAGIDKVRFRKPVIAGDTLIIRMTLIKLQKRFGIAKMEGKAYVGGDLVCEGEFLMATGSE

SEQ ID NO: 363 - DNA, 1056 bp, Oryza sativa
  CDS (1)..(1056)
atggaggccaccgccgccgccgccgcagcgcccgcgagatccgcgctccccttccggagccgcgtcgccgccgcagcacgcccaggacgcgcgccggcgctgtcggccgccccgggaaggcgcctcgtcgcgcgccgcgccgcgggcgacggccaggcggtggaggctcaggaggcgctccccatcgagaaaaggttccctcccttcccgagcgtcatggacatcaaccagatccgcgagatcctgccccacaggtttccattcctcctggttgatagagttattgagtacaagggaggagaatatgcagttgggatcaagaatgtcacgataaatgataacttcttccctgggcatttccccgaacgacccataatgcctggtgttctcatggttgaggctatggcccaggttgggggtctggtgatgttgcagcctgaaattggcggatctcgggacaatttcttctttgcaggaattgataaagtgaggttccgtaagccagtaattgcaggggataccttgatcatgagaatgactctgaccaagtatcagaaaagatttggtcttgccaagatggaaggaaaagcttacgttggtggtgacctagtgtgcgagggggagttcctcctgaggaaagaacatgatgaggtggccaacaatggattgtccatctttcttgatcctaagaggctcaaattacaggatggtgagattccaaacacgatggaggaagagaaaccatcagcaggtgttcaacctgatcctactgtgccaaccatggccttatcatggatgctaccaactcagggccaagagactatccatgacactatgaacactgcatatgagatgtcatcttcagaaacgccgccactcagagcagaccaagccgccgccgcggcgccgatggacgtcgaggttcagctccggcagcggcagcctcaggcgccgccgtgtcagcaggctcatttctggtcagttagtaatgatgaagacatgtgggctggatattggaaatatttggcgagtgaaatatcaatttgtttcttctga

SEQ ID NO: 364 - protein, 351 aa, Oryza sativa
MEATAAAAAAPARSALPFRSRVAAAARPGRAPALSAAPGRRLVARRAAGDGQAVEAQEALPIEKRFPPFPSVMDINQIREILPHRFPFLLVDRVIEYKGGEYAVGIKNVTINDNFFPGHFPERPIMPGVLMVEAMAQVGGLVMLQPEIGGSRDNFFFAGIDKVRFRKPVIAGDTLIMRMTLTKYQKRFGLAKMEGKAYVGGDLVCEGEFLLRKEHDEVANNGLSIFLDPKRLKLQDGEIPNTMEEEKPSAGVQPDPTVPTMALSWMLPTQGQETIHDTMNTAYEMSSSETPPLRADQAAAAAPMDVEVQLRQRQPQAPPCQQAHFWSVSNDEDMWAGYWKYLASEISICFF

SEQ ID NO: 365 - DNA, 651 bp, Triticum aestivum
  CDS (1)..(651)
atggagacagccgccgccgtgtccgtgcccagatccgcctgccgtgcccctctccccttcccggcgcccctcaagctccagggccgcgttgcgctcccccgccgggcgctccccggggcgccgaggcagcgcctcgtcgcgcgctgcgcggctgccgacgacagtgcggcggcagagctccccatcgagaaaaggttcgccgccttcccggccgtcatggacatcaaccagatccgcgagatcctgccccacaggttccccttcctcctggtagatagggtcatcgagtacaaggcaggagagtatgctgttgcgatcaagaatgtcacgataaatgacaacttcttccccggccacttcccggagcgcccgataatgcccggcgttctcatggttgaggccatggcccaggtcgggggcatcgtgatgctgcagcctgaagtcggtggatcccaagacaatttcttctttgcaggggttgataaggtgagattcaggaagccagtgattgctggtgacactctggtcatgaggatgaccctcaccaaatatcagaggaaattcgggcttgcaaagatggaaggaaaagcttatgtgggtggcgacgtagtgtgtgagggggagttcctccttattagcgccactgaatga

SEQ ID NO: 366 - protein, 216 aa, Triticum aestivum
METAAAVSVPRSACRAPLPFPAPLKLQGRVALPRRALPGAPRQRLVARCAAADDSAAAELPIEKRFAAFPAVMDINQIREILPHRFPFLLVDRVIEYKAGEYAVAIKNVTINDNFFPGHFPERPIMPGVLMVEAMAQVGGIVMLQPEVGGSQDNFFFAGVDKVRFRKPVIAGDTLVMRMTLTKYQRKFGLAKMEGKAYVGGDVVCEGEFLLISATE

SEQ ID NO: 367 - DNA, 960 bp, Brassica napus
  CDS (51)..(722)
gaaaaacactcttcgaagtctccgtccccttctctcgagatcaatcgacaatggctgcctctaactccattttcaccatctctccgtcgagaaatgttgcacgtatctctcttaaccactccttatcgccgccgttgagtcttccactcaacagatcaagctctgtcgcgtttcgtcccaagccacgatccagctcgctagtcttatgctccaccgatgaatcaaagatcaccgcggagaaagagatcccaatagagctcaggtacgaggcgtttccgacagtgatggacattaaccagatacgtgagatattgcctcacaggttcccgtttctgttagtggatagagtgatagagtacacacctggtgtatctgctgtagctatcaaaaacgttaccattaatgataatttctttcctgggcattttcctgagaggcccattatgcctggagtcctcatggttgaggccatggctcaggtgggaggtatagtgatgctacaaccagaagtgggcggatctaaaagcaacttcttctttgctggaatcgacaaagtcagattcagaaagcctgtgactgcaggtgatactttggtgatgaagatgacgcttgtgaagatgcagaagaggtttgggatagcgaaaatggaagggaaagcatacgtagggaacactgtggtatgcgaaggagaattcttgatggctatgggaaaagaagagtagtgattatgttctcgtgccttttgcttttttttttcttacccttgtgggtacgagtttatcacacattgagtctcatttctatctctagtttctgttgtttgttccaaatgttgttgactatttacaagaaaataatgaattggagttatcacaaaaaaaaaaaaaaaaagggggccgttttaaggaacccaggtttactcccgcgggctggcaaggtaaaactttttttatggggccc

SEQ ID NO: 368 - protein, 223 aa, Brassica napus
MAASNSIFTISPSRNVARISLNHSLSPPLSLPLNRSSSVAFRPKPRSSSLVLCSTDESKITAEKEIPIELRYEAFPTVMDINQIREILPHRFPFLLVDRVIEYTPGVSAVAIKNVTINDNFFPGHFPERPIMPGVLMVEAMAQVGGIVMLQPEVGGSKSNFFFAGIDKVRFRKPVTAGDTLVMKMTLVKMQKRFGIAKMEGKAYVGNTVVCEGEFLMAMGKEE

SEQ ID NO: 369 - DNA, 933 bp, Brassica napus
  CDS (24)..(698)
cgggtcgacgatttcgttcgacaatggctgcctctaactccattttcaccatctctccgtcgagaaatgttgcacgtatctctcttaaccactccttatcgccgccgttgagtcttccactcaacagatcaagctctgtcgcgtttcgtcccaagccacgatccagctcgctagtcttatgctccaccgatgaatcaaagatcaccgcggagaaagagatcccaatagagctcaggtacgaggcttttccgacagtgatggacattaaccagatacgtgagatattgcctcacaggttcccgtttctgctagtggatagagtgatagagtacacacctggtgaatctgctgtagctatcaaaaacgttaccattaatgacaatttctttcctgggcattttcctgagaggcccattatgcctggtgtcctcatggttgaggccatggctcaggtgggaggtatagtgatgctaaatccagaagtgggcggatctaaaagcaacttcttctttgctggagtcgacaaagtgagattcagaaagcctgtgattgcaggtgacactctggtgatgaggatgacgcttgtgaagctgcagaagcggtttgggatagccaaaatggaagggaaagcatacgtagggaacactttggtatgcgaaggagagttcttgatggctatggggaaagaagaggagtgatcatgttctcatgccttttgcttttttttttcttacccttgtgggtacgagtttatcacacattgagtctcatttctatctctagtttctgttgtttgttccaaatgttgttgactatttacaagaaaataatgaattggagttatcacaaaaaaaaaaaaaaaaagggggccgttttaaggaacccaggtttactcccgcgggctggcaaggtaaaactttttttatggggccc

SEQ ID NO: 370 - protein, 224 aa, Brassica napus
MAASNSIFTISPSRNVARISLNHSLSPPLSLPLNRSSSVAFRPKPRSSSLVLCSTDESKITAEKEIPIELRYEAFPTVMDINQIREILPHRFPFLLVDRVIEYTPGESAVAIKNVTINDNFFPGHFPERPIMPGVLMVEAMAQVGGIVMLNPEVGGSKSNFFFAGVDKVRFRKPVIAGDTLVMRMTLVKLQKRFGIAKMEGKAYVGNTLVCEGEFLMAMGKEEE

SEQ ID NO: 371 - DNA, 1212 bp, Zea mays
  CDS (159)..(830)
  misc_feature (1212)..(1212): n is a, g, c or t
ccccgcgtccggttcccaaaggaaagccccacaaaacctcggttgctccccttggcccttgccatcctcgttcctatcgccagttcgccacctcctttgctctcgcctcgcgcgcgctcccccccgcgcatcgtgccgttcgccaccgcaccgcgccgatggaggtcgccgccgtgcccagatccgccgcggcctgccgtgcggcgcccctgctcccggccgtccgagccgctgcgtgccacctggccctgccccggcgcgcgttctccgcatccgtcgcggcggcaccggcgccgcgccgcctcgccgctcgtcgcgctgcggatggtgacagcgtggagacggcgccggaggcggtccccattgagaaaaggttccctcccttcccgagcgtcatggacatcaaccagatccgcgagatcctcccccacaggttcccattccttttggttgatagagtaattgaatacaaggctggagaatatgcagtggggatcaagaatgttacaataaatgataatttcttcccaggacattttcctgaacgccccataatgcccggtgtcctcatggtcgaggctatggcccaggttgggggtctggtgatgctgcaacctgaagttggtggatctcgagacaacttctttttcgccgggattgacaaagttaggttcaggaagccagtgattgctggcgatacactgatcatgaggatgacactgactaagtatcagaagaggtttggactcgccaagatggaaggaaaagcttatgttggtggtgacctagtttgtgaaggggagttcctcctagtcagcgcaaccgagtagtgcaaagacacttcatgattctctgggaagaatcattggttggaatcagatctggttggatgtttgaaagaaccgagttttgaactaattatacaatcggcagttgaggcgatcctttacctgttcttaagcatgttgttgagtccatgtggtgatttctatcggttaccaagggcccaaggctgaatccacgccatgttatgttgcaattgaggattacaatatattgggtaattgtttgatggaataaacgataatgcttttgtaaaaaaaaaaaaaaaaaaaaaaaaaaagggttagcggccgctctagaggatccaagcttacgtacgcgtgcatgcgacgtcatagctcttcaatagtgtcacctaaattcaaggcn

SEQ ID NO: 372 - protein, 223 aa, Zea mays
MEVAAVPRSAAACRAAPLLPAVRAAACHLALPRRAFSASVAAAPAPRRLAARRAADGDSVETAPEAVPIEKRFPPFPSVMDINQIREILPHRFPFLLVDRVIEYKAGEYAVGIKNVTINDNFFPGHFPERPIMPGVLMVEAMAQVGGLVMLQPEVGGSRDNFFFAGIDKVRFRKPVIAGDTLIMRMTLTKYQKRFGLAKMEGKAYVGGDLVCEGEFLLVSATE

SEQ ID NO: 373 - DNA, 948 bp, Zea mays
  CDS (49)..(708)
cacgcgcttccgccccccgccctcctgtaccgctctccttccccgacgatggatcccgcagccatgtcgagatccccgtgctctatcgtctcgccgggctccttattaaccgccccacttctcccagtacgcctcgccgtccagccacgccgccgagtgcctgcttttattgcgccctccggcaggccgtccgtcgcgcggcgcgccgcggccggagacaagttcgaggccgagacgcccatagagaaaagtttccctcccttcccaactgtcatggacatcaaccagatccgtgacatcctgccacataggttcccgtttcttctggttgacagagttattgattacaaaccaggagaatatgctgttgcaatcaagaatgtgacaattaatgataacttcttcccagggcatttccctgaacgacccataatgcctggtgttctcatggtcgaggcaatggcccaggtcggaggaatagtgatgttgcagcctgaagtgggtggatctcgagagaacttcttttttgcggggatcgataaagtgaggttccggaagcccgtgatcgctggagacaccttgatcatgagaatgactctgatcaagctgcagaagagattcggaattgcaaagatggaagggaaagcttacgttggcgccgacctagtatgcgaaggggagttcttgatggctactggatcagaatgaaggcaggagacacatggattgatggatacataatatttcaagtttttactgtgaaatcagctttccagtctaataagttttgaactgtgtctgtaatagcggtgtaatgtcgttgctagtcttaggtgccgtttggttcacatatttgtaacgtaatgggtaacatataacgttaaatcatgtttgttttagtccaaccgtaatcagataccacactaaaatttgatatcagcctattta

SEQ ID NO: 374 - protein, 219 aa, Zea mays
MDPAAMSRSPCSIVSPGSLLTAPLLPVRLAVQPRRRVPAFIAPSGRPSVARRAAAGDKFEAETPIEKSFPPFPTVMDINQIRDILPHRFPFLLVDRVIDYKPGEYAVAIKNVTINDNFFPGHFPERPIMPGVLMVEAMAQVGGIVMLQPEVGGSRENFFFAGIDKVRFRKPVIAGDTLIMRMTLIKLQKRFGIAKMEGKAYVGADLVCEGEFLMATGSE

SEQ ID NO: 375 - DNA, 25 bp, Artificial sequence
  primer
atgactactaacactcatactctgc

SEQ ID NO: 376 - DNA, 22 bp, Artificial sequence
  primer
ttaggcctcccggctacgagca

SEQ ID NO: 377 - protein, 130 aa, Artificial sequence
  consensus sequence
  Variant (2)..(4): Xaa in position 2 to 4 is any amino acid
  Variant (14)..(14): Xaa in position 14 is any amino acid
  Variant (18)..(26): Xaa in position 18 to 26 is any amino acid
  Variant (27)..(28): Xaa in position 27 to 28 is any or no amino acid
  Variant (30)..(30): Xaa in position 30 is any amino acid
  Variant (34)..(35): Xaa in position 34 to 35 is any amino acid
  Variant (38)..(39): Xaa in position 38 to 39 is any amino acid
  Variant (41)..(41): Xaa in position 41 is any amino acid
  Variant (46)..(47): Xaa in position 46 to 47 is any amino acid
  Variant (49)..(50): Xaa in position 49 to 50 is any amino acid
  Variant (55)..(56): Xaa in position 55 to 56 is any amino acid
  Variant (59)..(59): Xaa in position 59 is any amino acid
  Variant (62)..(78): Xaa in position 62 to 78 is any amino acid
  Variant (79)..(85): Xaa in position 79 to 85 is any or no amino acid
  Variant (87)..(87): Xaa in position 87 is any amino acid
  Variant (89)..(89): Xaa in position 89 is any amino acid
  Variant (91)..(92): Xaa in position 91 to 92 is any amino acid
  Variant (95)..(97): Xaa in position 95 to 97 is any amino acid
  Variant (99)..(99): Xaa in position 99 is any amino acid
  Variant (103)..(103): Xaa in position 103 is any amino acid
  Variant (105)..(123): Xaa in position 105 to 123 is any amino acid
  Variant (124)..(125): Xaa in position 124 to 125 is any or no amino acid
  Variant (127)..(127): Xaa in position 127 is any amino acid
  Variant (129)..(129): Xaa in position 129 is any amino acid
IXXXLPHRYPFLLXDRVXXXXXXXXXXXAXKNVXXNEXXFXGHFPXXPXXPGVLXXEAXAQXXXXXXXXXXXXXXXXXXXXXXXXFXGXDXXRFXXXVXPGDXLXXXXXXXXXXXXXXXXXXXXXAXVXG

SEQ ID NO: 378 - protein, 21 aa, Artificial sequence
  protein pattern
  Variant (2)..(2): Xaa in position 2 is Ala or Val
  Variant (3)..(3): Xaa in position 3 is Ala, Gly or Ser
  Variant (4)..(4): Xaa in position 4 is any amino acid
  Variant (6)..(7): Xaa in position 6 to 7 is any amino acid
  Variant (8)..(8): Xaa in position 8 is Lys or Arg
  Variant (10)..(10): Xaa in position 10 is Lys or Arg
  Variant (11)..(12): Xaa in position 11 to 12 is any amino acid
  Variant (14)..(14): Xaa in position 14 is any amino acid
  Variant (15)..(15): Xaa in position 15 is Ala or Pro
  Variant (18)..(18): Xaa in position 18 is any amino acid
  Variant (19)..(19): Xaa in position 19 is Ile, Leu, Met or Val
  Variant (20)..(20): Xaa in position 20 is any amino acid
  Variant (21)..(21): Xaa in position 21 is Phe, Ile, Leu, Met or Val
FXXXDXXXFXXXVXXGDXXXX

SEQ ID NO: 379 - protein, 16 aa, Artificial sequence
  protein pattern
  Variant (5)..(5): Xaa in position 5 is Phe or Tyr
  Variant (7)..(7): Xaa in position 7 is any amino acid
  Variant (8)..(8): Xaa in position 8 is any or no amino acid
  Variant (10)..(10): Xaa in position 10 is any amino acid
  Variant (11)..(11): Xaa in position 11 is any or no amino acid
  Variant (14)..(14): Xaa in position 14 is Ile or Val
  Variant (15)..(15): Xaa in position 15 is any amino acid
  Variant (16)..(16): Xaa in position 16 is Asp, Glu or Ser
LPHRXPXXLXXDRXXX

SEQ ID NO: 380 - DNA, 1104 bp, Escherichia coli K12
  CDS (1)..(1104): transl_table=11
atgagtgacagccagacgctggtggtaaaactcggcaccagtgtgctaacaggcggatcgcgccgtctgaaccgtgcccatatcgttgaacttgttcgccagtgcgcgcagttacatgccgccgggcatcggattgttattgtgacgtcgggcgcgatcgccgccggacgtgagcacctgggttacccggaactgccagcgaccatcgcctcgaaacaactgctggcggcggtagggcagagtcgactgattcaactgtgggaacagctgttttcgatttatggcattcacgtcgggcaaatgctgctgacccgtgctgatatggaagaccgtgaacgcttcctgaacgcccgcgacaccctgcgagcgttgctcgataacaatatcgttccggtaatcaatgagaacgatgctgtcgctacggcagagattaaggtcggcgataacgataacctttctgcgctggcggcgattcttgcgggtgccgataaactgttgctgctgaccgatcaaaaaggtttgtataccgctgacccgcgcagcaatccgcaggcagaactgattaaagatgtttacggcattgatgacgcactgcgcgcgattgccggtgacagcgtttcaggcctcggaactggcggcatgagtaccaaattgcaggccgctgacgtggcttgccgtgcgggtatcgacaccattattgccgcgggcagcaagccgggcgttattggtgatgtgatggaaggcatttccgtcggtacgctgttccatgcccaggcgactccgcttgaaaaccgtaaacgctggattttcggtgcgccgccggcgggtgaaatcacggtagatgaaggggcaactgccgccattctggaacgcggcagctccctgttgccgaaaggcattaaaagcgtgactggcaatttctcgcgtggtgaagtcatccgcatttgcaacctcgaaggccgcgatatcgcccacggcgtcagtcgttacaacagcgatgcattacgccgtattgccggacaccactcgcaagaaattgatgcaatactgggatatgaatacggcccggttgccgttcaccgtgatgacatgattacccgttaa

SEQ ID NO: 381 - protein, 367 aa, Escherichia coli K12
MSDSQTLVVKLGTSVLTGGSRRLNRAHIVELVRQCAQLHAAGHRIVIVTSGAIAAGREHLGYPELPATIASKQLLAAVGQSRLIQLWEQLFSIYGIHVGQMLLTRADMEDRERFLNARDTLRALLDNNIVPVINENDAVATAEIKVGDNDNLSALAAILAGADKLLLLTDQKGLYTADPRSNPQAELIKDVYGIDDALRAIAGDSVSGLGTGGMSTKLQAADVACRAGIDTIIAAGSKPGVIGDVMEGISVGTLFHAQATPLENRKRWIFGAPPAGEITVDEGATAAILERGSSLLPKGIKSVTGNFSRGEVIRICNLEGRDIAHGVSRYNSDALRRIAGHHSQEIDAILGYEYGPVAVHRDDMITR

SEQ ID NO: 382 - DNA, 1086 bp, Prochlorococcus marinus str. MIT 9303
  CDS (1)..(1086): transl_table=11
atgagtctgtgggtggtgaaggtgggaaccagcctgctgagaggcaatgagaagcaatccaccgccgaagtgattgagagctacagcgcctgtctttcagcaagcctcaagcggggggatcatgttgtcctcgtaacaagtggcgccgtaggtctgggttgcaatcgtctagggctaagccaacggccggttgatgtggtggctctccaagcgacggcggctatcggccaaggacaactcatggctctctatgaggctgccatgagccgaaggggctacaccgtggctcaggtattgctcacccgctcagatcttggctcgaggcagcgataccgcaatgcttcaagcaccttgaagcaattactcgactggggcgtgctgccggtggtgaatgagaacgacgccctctctccggaagaattgcgttacggcgacaacgacaccctttcagctctcgttgcaaccgcagtggaggctgatcagctcatcatgctcaccgacgtggatcgcctttattcctcagatccccgcattaatgcctctgccgaaccgatctcagatgtttaccatccccatgaactgactgccctggaagtcgcggcaggggagggaggtccctggggtactgggggtatgagtacaaaacttgcggcagctcgcatcgctaccgcaagtggcatcaccgttcttcttgctgatggccgcgatcctcaagtgcttgatgggttgctgcaaggaagacggagcggcacggtgtttcatcctcaccctcaacctctcggtaatcgcaagagctggctggctcatgccctcaagcccttagggacccttcagctggatgaaggcgcctgcgatgcccttcaacatcgtggcgcctccctactcttggtgggggttaaagaggtggaaggaaactttgaagccaaccagccggtaagactaattaatcccgaaggtaacgagctcgctcgaggcttgtgttccttgagtagcaatgaactgcgcgaggccattgagacccaaatgagcacgaatcgttcaccggtcgtggtgcatagggacgtgttggttctccgcaacgcgtga

SEQ ID NO: 383 - protein, 361 aa, Prochlorococcus marinus str. MIT 9303
MSLWVVKVGTSLLRGNEKQSTAEVIESYSACLSASLKRGDHVVLVTSGAVGLGCNRLGLSQRPVDVVALQATAAIGQGQLMALYEAAMSRRGYTVAQVLLTRSDLGSRQRYRNASSTLKQLLDWGVLPVVNENDALSPEELRYGDNDTLSALVATAVEADQLIMLTDVDRLYSSDPRINASAEPISDVYHPHELTALEVAAGEGGPWGTGGMSTKLAAARIATASGITVLLADGRDPQVLDGLLQGRRSGTVFHPHPQPLGNRKSWLAHALKPLGTLQLDEGACDALQHRGASLLLVGVKEVEGNFEANQPVRLINPEGNELARGLCSLSSNELREAIETQMSTNRSPVVVHRDVLVLRNA

SEQ ID NO: 384 - DNA, 1191 bp, Vibrio cholerae O1 biovar eltor str. N16961
  CDS (1)..(1191): transl_table=11
ttgcagtgtggattgctaaaacatcgtctcttaaagtttttctcaacagaagcaatcatgaccacaaatcaacgaagcatcaaagctccacaaacggttgttgtgaagctgggaaccagtgttctgaccggcggtactcttgcgctggatcgtgctcatatggttgagctcgctcgccagtgtgctgaactcaaaaagcaaggtcactcagtagtgatcgtgacctcgggcgccattgcggctggccgtgagcatttaggttaccctgcgctgcccaacgcgatttccagcaagcaactgctggcagcggttgggcaaagtcgtttgattcaggtctgggaatcgttatttgcgatttatggcatcaaaattggtcagatgctgctcacccgtgctgatcttgatgaccgtgagcgtttccttaatgcgcgtgacaccatcaatgcgttagttgaaaatggcattgtgcctgtggtcaacgaaaacgatgcggtagcaaccaatgaaatcaaagtcggtgacaacgataacttatcggcgctggtcggtattttgtgtggtgcggataagctgctgctgttgaccgatcaaaaaggcttgttcaccgccgatccgcgtaaagatcccaatgcccaactgatcaaagaagtgaccaccattgatgacacactgcgcaaaattgctggtggcagtggcactacactcggtacgggcggcatggccaccaagctgcaagcggcggacattgctcgtcgtgctggtattgaagtcatcattgcggcaggtcgtgcgcccaatgtgatttttgactccttaagtgatgagccacaaggcacgcgcttcttagctttggaagaagcgttagaaaaccgcaaacgctggattttggcaggcccagcggcatcaggcgatattgtgattgacgatggcgcagtgaaagcggtgcaaaccaagggcagcagcttgctcgccaaaggtgtggtgcgagtgcaaggtcagttcgcccgtggtgaagtggtgcgggtactggataagcaaagtcatctgattgcgcgcggcatcgcggcctactccaatgacgagttggcgcaaattgctggtaagcacagtaaagagatcatcgatattttaggctacgatcacggctcagaagtgatccaccgcgacgacatggtcgtgattcaagagtaa

SEQ ID NO: 385 - protein, 396 aa, Vibrio cholerae O1 biovar eltor str. N16961
MQCGLLKHRLLKFFSTEAIMTTNQRSIKAPQTVVVKLGTSVLTGGTLALDRAHMVELARQCAELKKQGHSVVIVTSGAIAAGREHLGYPALPNAISSKQLLAAVGQSRLIQVWESLFAIYGIKIGQMLLTRADLDDRERFLNARDTINALVENGIVPVVNENDAVATNEIKVGDNDNLSALVGILCGADKLLLLTDQKGLFTADPRKDPNAQLIKEVTTIDDTLRKIAGGSGTTLGTGGMATKLQAADIARRAGIEVIIAAGRAPNVIFDSLSDEPQGTRFLALEEALENRKRWILAGPAASGDIVIDDGAVKAVQTKGSSLLAKGVVRVQGQFARGEVVRVLDKQSHLIARGIAAYSNDELAQIAGKHSKEIIDILGYDHGSEVIHRDDMVVIQE

SEQ ID NO: 386 - DNA, 1161 bp, Pasteurella multocida subsp. multocida str. Pm70
  CDS (1)..(1161): transl_table=11
atgattaatggtaagttagcttcaattttgtgcgacaaaaataagaagatagagaagatgaaaatcgacaaaacactcgttgtgaaatttggaaccagtacgcttacgcaaggatcggcgaagttaaatttacctcatatgatggatattgtgcgtcagctcgcacagcttcatcaagcgggctttcgtttagtgattgtcacctcaggggcgattgcggcaggtcgtcattatttaaatcacccgcaattgccgccgacgattgcctcgaaacaattattggctgcggtaggacaaagtcagctcattcaaacgtgggaaaaattgtttgccatttatgatattcatattgggcagattttattgacccgtgccgacattgaagatcgtgaacgttttttaaatgccagagatactttgcgcgccttattagataatcagattattccagtgattaatgaaaatgacgctgtcgctacgtcagaaattaaagtaggcgataacgataatttatccgcgttagtggcgattttagtgcaagcagaacagttgtatttgcttactgatcagcaaggtttgtttgatcgtgatccgcgcaaacatccagacgccaaattgatcgccgacgtggacaaaattaccgatcatattcgcgcgattgcgggcggaagtggcacctcgttaggcacaggcggcatgtccaccaaaatcagtgccgcggatgtggcaacccgctccggcattgaaactattattgcaccgggtaatcgcccgaatgtgattgtggacttagcttatgggcaagccattggcaccaaatttagtgtgcaagcagatcgcttagaaagtcgtaaacaatggctatatgcggcgccgtcagccggtattattaccattgatgcgggggcggaaaacgcgatgttaatgcaacataaatcgttattgcctgctgggattgtgaacgtggaaggacgcttttcacgcggtgaagtggtaaaaattcgtactcagcaaggtaaggatgtcgccttagggatgccacgttataacagcgatgcactccatttaattcaaggcaaacattcgcaagatatcgaacaggttctcggttatgaatatggggcggttgcggtacaccgcgacgatatgattgtgttataa

SEQ ID NO: 387 - protein, 386 aa, Pasteurella multocida subsp. multocida str. Pm70
MINGKLASILCDKNKKIEKMKIDKTLVVKFGTSTLTQGSAKLNLPHMMDIVRQLAQLHQAGFRLVIVTSGAIAAGRHYLNHPQLPPTIASKQLLAAVGQSQLIQTWEKLFAIYDIHIGQILLTRADIEDRERFLNARDTLRALLDNQIIPVINENDAVATSEIKVGDNDNLSALVAILVQAEQLYLLTDQQGLFDRDPRKHPDAKLIADVDKITDHIRAIAGGSGTSLGTGGMSTKISAADVATRSGIETIIAPGNRPNVIVDLAYGQAIGTKFSVQADRLESRKQWLYAAPSAGIITIDAGAENAMLMQHKSLLPAGIVNVEGRFSRGEVVKIRTQQGKDVALGMPRYNSDALHLIQGKHSQDIEQVLGYEYGAVAVHRDDMIVL

SEQ ID NO: 388 - DNA, 1158 bp, Xanthomonas axonopodis pv. citri str. 306
  CDS (1)..(1158): transl_table=11
atgagcacgcctgccagcacgtcgtcgccctttaccgagcaggcattgccgccatggcgccgtgcggtgctcaaggtcggcagcagcctgctcgccgccgatgggggggggctgtccccgcgcttcgcgctcggtctggcgcagttcgtctccgccaatctggcagccgggcgcgagctggtgatcgtgtcgtcgggcgcggtggccgccggccgtgccatcctgcccaaagcgatggatgtcggcgcaccgatcgcggcacggcaggcactggccgccttgggccaggcgcagttgattgcgttgtggcagcgctttttcgagcgaccggtggcgcaggtactgctcacgcatgacgacctgcgcaaccgtcgccgctacctcaatgcgcgtgccaccttgggcgagttgctgcggctgggcgcgctgccggtgatcaacgaaaacgataccgtctcggtggatgagttgaagctgggcgataacgacaacctggctgcgatcgtggctgcgctggtcgatgccgacgcgttgtttatcgccaccgatatcgatggcttgtatagcgccgacccacgcagcaacccgttggcgcgcccgctcgacgatgtgcccgagctcactccggaggtgctggcgatggccggcggcagcggtagcaatgtgggtaccggaggcatgcgcaccaaactggaagccgctgcaaaggccggcgcggccggcatcgaaacctatctgttcaacggccgaagtggcgaggtggtgcgcgccctggcgctggaccgcctgcgtggcacgcggatccacgccgcacgcacgcgcatcgctgcgcgaaaatactggctgcggcacgcaccggtggaagcgggcgcgatcctcatcgacgacggcgccgcagcggccttgaccggcaagggcgcttcgctgttgccaggcggggtggccggcgcgcagggcgatttccgtcgcggcgacatggtggagatccgtcggcgcgataccacgggcgacggacagtgtctggcacgcggcgtcagccagtattcggccctggatatccgtcgtatcgcaggccgccattcgcgcgagatcgagaacgtgctcggctacagttacggcgaaaacgtggtgcatcgcgatgatttggtggtgttgtag

SEQ ID NO: 389 - protein, 385 aa, Xanthomonas axonopodis pv. citri str. 306
MSTPASTSSPFTEQALPPWRRAVLKVGSSLLAADGGGLSPRFALGLAQFVSANLAAGRELVIVSSGAVAAGRAILPKAMDVGAPIAARQALAALGQAQLIALWQRFFERPVAQVLLTHDDLRNRRRYLNARATLGELLRLGALPVINENDTVSVDELKLGDNDNLAAIVAALVDADALFIATDIDGLYSADPRSNPLARPLDDVPELTPEVLAMAGGSGSNVGTGGMRTKLEAAAKAGAAGIETYLFNGRSGEVVRALALDRLRGTRIHAARTRIAARKYWLRHAPVEAGAILIDDGAAAALTGKGASLLPGGVAGAQGDFRRGDMVEIRRRDTTGDGQCLARGVSQYSALDIRRIAGRHSREIENVLGYSYGENVVHRDDLVVL

SEQ ID NO: 390 - DNA, 1077 bp, Bordetella pertussis Tohama I
  CDS (1)..(1077): transl_table=11
gtgggttcctcgctggtcaccaacgaaggccggggcctcgatcgcgccgcggtaggccactgggcagcccagatcgccgccctgcaccagcagggcaagcaggtcgtgctggtttccagcggcgccattgccgaaggcatggcgcggctgggctggcgcaagcgcccttcggccatgcacgaattgcaggccgccgccgccgtgggccagatgggcctgtgccaggcttacgaagccgccttcgccgagttcggcctgcgcaccgcgcagatcctgctcacccacgaagacctggccgaccggcaccgctacctgaatgcgcgctcgaccctgttcgccctgctgcgcctgggcgtagtgcccatcgtcaacgaaaacgacaccgtcgtcaccgacgaaatccgcttcggcgacaacgacaccctgggcgccctggtcaccaacctgatcgaagccgatgcgctcatcatcctgaccgaccagcgcggcctgtacgaagccgacccgcgccgcgacccggccgcgcgcttcgtggcgcatgcgcaagccggcgatgccgccctggaagccatggccggcggcgccggcagcggcgtgggcaccggcggcatgctcaccaagatcctggcggccaagcgggccgcccacagcggcgcccataccgtcatcgcatcaggccgcgaacgcaatgtgctgacccgcctggcgcaaggcgaatgcatcggcacggaattgcgcgcggtcctgccggtatggtcggcgcgcaagcaatggctggccgaccacctgcgcctgcgcggccgcgtggtgctcgatgatggcgccgtgcatgccctgctgcacgagggcaagagcctgctgcccatcggcgtggccgaagtccagggcgagttcgagcgcggcgacgtcgtggcctgcgtcgacatgcatggacgcgagtgcgcgcgcggcctgatcaattattcgtcggccgatacccggcgcatcctgcgccagccgtcgagccagatcgcgcgcatcctgggcagcatgacagacccggaactgatgcaccgcgacaacctggtcgtcacctga

SEQ ID NO: 391 - protein, 358 aa, Bordetella pertussis Tohama I
MGSSLVTNEGRGLDRAAVGHWAAQIAALHQQGKQVVLVSSGAIAEGMARLGWRKRPSAMHELQAAAAVGQMGLCQAYEAAFAEFGLRTAQILLTHEDLADRHRYLNARSTLFALLRLGVVPIVNENDTVVTDEIRFGDNDTLGALVTNLIEADALIILTDQRGLYEADPRRDPAARFVAHAQAGDAALEAMAGGAGSGVGTGGMLTKILAAKRAAHSGAHTVIASGRERNVLTRLAQGECIGTELRAVLPVWSARKQWLADHLRLRGRVVLDDGAVHALLHEGKSLLPIGVAEVQGEFERGDVVACVDMHGRECARGLINYSSADTRRILRQPSSQIARILGSMTDPELMHRDNLVVT

SEQ ID NO: 392 - DNA, 1191 bp, Vibrio vulnificus YJ016
  CDS (1)..(1191): transl_table=11
ttgattgttaaaacatcttctctatttttgtgtttcatttcagaagacatcatgacaacgaatcaacaaagcgtcgctgcttctcaaccaaaaactatcgttgtgaagcttggaaccagtgtgttaacaggtggtacattagcgttagatcgcgctcatatggttgagcttgcgcgccaatgtgcagagttaaaaaaacaaggccactctgtggtggtcgtctcgtcaggcgcgattgccgctggacgtgagcacttaggttaccccgcgctgcccaatgcgatggcaagcaaacagttgcttgctgcggttgggcaaagtcagttgattcaaacctgggaatcgttatttgcactgtatggcatcaaaattggccaaatgttgctcactcgagcggatctcgaagatcgcgaacgttttctcaatgctcgagatacgattaacgcgttagtggataacggcattatccctgtcgttaatgaaaatgacgccgtcgccacgagcgaaatcaaagtgggtgacaacgacaacctctctgcgttggtgggcattttatgtggtgctgataaactactgttgctgacagaccaaaaaggcttgtataccgccgatccgcgtaaagatcccaatgctgagctgatcaaagaagttaaagtcattgacgatactttgcgtaaaattgctggtggcagcggtacaacattaggtactggtgggatggcaacaaagctccaagctgcggacattgcgcgtcgtgctggcattgaagtcatcattgcggcaggccgtggtcaaaatgtcatttttgatgcgttgagcccagcccctcaaggaacccgtttcttgccttgtgaagaggcgttggaaaaccgcaagcgttggattctcgctggccctgcggcctctggtgatattgtgattgaccaaggtgcggtgaaagccgtggtcgaaaaagggagcagtttgttggcgaaaggggtgaccaaagtacttggcgagttttctcgtggcgaagtagttcgtgtaacggatgcacagggccatttggttgcgcgaggtattgcgagttattccaaccaagatatggcgaaaattgccggtaagcacagcaaagacattatttcgattctgggctatgactatggttcagaagtgattcaccgtgacgacatggttgtcattcaagaatag

SEQ ID NO: 393 - protein, 396 aa, Vibrio vulnificus YJ016
MIVKTSSLFLCFISEDIMTTNQQSVAASQPKTIVVKLGTSVLTGGTLALDRAHMVELARQCAELKKQGHSVVVVSSGAIAAGREHLGYPALPNAMASKQLLAAVGQSQLIQTWESLFALYGIKIGQMLLTRADLEDRERFLNARDTINALVDNGIIPVVNENDAVATSEIKVGDNDNLSALVGILCGADKLLLLTDQKGLYTADPRKDPNAELIKEVKVIDDTLRKIAGGSGTTLGTGGMATKLQAADIARRAGIEVIIAAGRGQNVIFDALSPAPQGTRFLPCEEALENRKRWILAGPAASGDIVIDQGAVKAVVEKGSSLLAKGVTKVLGEFSRGEVVRVTDAQGHLVARGIASYSNQDMAKIAGKHSKDIISILGYDYGSEVIHRDDMVVIQE

SEQ ID NO: 394 - DNA, 1284 bp, Candida glabrata CBS 138
  CDS (1)..(1284)
atgaccgaaactagagttggtggtaagccatttacaattgtgatcaagcttggtacgtcttctttggttgatgagaagaccaaagaaccaaggctagctatcatgtccttgattgtggaaactgttgtcaaattacgtaggttaggccataatgttgtaatcgtttctagtggtagtataggtgttgggctgcacattttgggtatggagaagaggcctaaacatctgtcagaagtccaagcaattgcggccattggtcaaagcaaactgattggtagatgggactccttgtttgctcattttgggcaatctattgctcaaattcttctaacgagaaatgacattctagactggtctcaataccgaaacgctcaaaatactgtggaagagcttttaaagatgggtgtagttccaattatcaatgaaaatgatacattatctgttcaagagattaagtttggtgataacgatactctttcagctattacagcagggttgatacatgctgattatttattcctattaactgacgtggactgcttgtacaccgctgatccaagaagtgatcctgatgctaaaccaattttaattgttccagacctgtccaaaggtctaccaggtgttgatacatcatcgggttctgggtctgacgttggtacgggtggtatgcagacaaagttagtcgctgctgagcttgcaaccaacgctggtgttcatacaatcataatgaaaagtgatgctccttccaatatttacaagattgtgaaatatatacaatcattgcatgacactggtgaagataacaaagtatttgaaggtgatttaatgaaacttcagcttgaagagtatgaaaagcttgacagaatgggcgttccctttcacactaagtttttggccaatagtatatcgcgccacttaagaaataaagaattttggattttgcatggtttagttacttctggggcagtgattattgatgaaggtgcctacaaggctttgacaagaaagaacaaagccggtttgttacccgtcggtgtcattgaaattgaaggatccttccatgaaatggagtgtgttgacttaaaggttggtaaacgtttgccaaatggagaattggatcctgattacccactaacaattgttggaagggccagatgtaattatccatcattagaaattagcaaaatcaaagggcaacaaagtgatgagatcgagaacgaattaggttactgcaactccgaatatatcgctcatagagagaatatggcattcccaccacattaa

SEQ ID NO: 395 - protein, 427 aa, Candida glabrata CBS 138
MTETRVGGKPFTIVIKLGTSSLVDEKTKEPRLAIMSLIVETVVKLRRLGHNVVIVSSGSIGVGLHILGMEKRPKHLSEVQAIAAIGQSKLIGRWDSLFAHFGQSIAQILLTRNDILDWSQYRNAQNTVEELLKMGVVPIINENDTLSVQEIKFGDNDTLSAITAGLIHADYLFLLTDVDCLYTADPRSDPDAKPILIVPDLSKGLPGVDTSSGSGSDVGTGGMQTKLVAAELATNAGVHTIIMKSDAPSNIYKIVKYIQSLHDTGEDNKVFEGDLMKLQLEEYEKLDRMGVPFHTKFLANSISRHLRNKEFWILHGLVTSGAVIIDEGAYKALTRKNKAGLLPVGVIEIEGSFHEMECVDLKVGKRLPNGELDPDYPLTIVGRARCNYPSLEISKIKGQQSDEIENELGYCNSEYIAHRENMAFPPH

SEQ ID NO: 396 - DNA, 1275 bp, Debaryomyces hansenii CBS767
  CDS (1)..(1275)
atgtcagattcaaagtcatatataattgtcatcaaacttgggacctcatctttagtagatgaggttaccagagaaccaagaattgcaaatatgtcgcttatagtggaaactattgtcaaacttcgtcgccagggacacaagatagtccttgtctcatctggggcgattgcgtttgggatgaaaagggttggtatttctagcaaaccatcaaagttagctgcggtccaagcgttggcatcaattggtcaaggtcgcttaattggattatttgatgatctctttaggcaaatggagcagactattgggcagattttgcttacaagaaatgatataagtgattttaaccagtataagaatgctaaaaatacgttacatgaattattggacatgggagtgattccaattgtaaatgaaaatgacacgttatcagtagctgaaattaaatttggtgataatgatacgctttcggcaattactgcaggcatggttcatgccgactatttattcttaatgacagacgttcaatgcttatacacagacaacccaaggagtaatccagatgcagaacctatactagtggtagacaaagttgatgatttggacgtgaaaaccgatacagaatcgggcggatccaaagtgggtactgggggtatgactacaaaattaatcgcagctggattggctactaatgttggtgtcactactataataaccctttctagtcaaccagactcgattttatctattgtgtcaaatattcagtctatggataagcttgatttatctactgaacagcaaactagatatatagctggtgagatcaaaaaaaacaaaatccccctccatacacgcttcttagggttacctcgtgcaactaagataatatcggataagagattctggttattacatggtataaaaactaagggaactttatatattgatcatctatgttatgaagccttaactagaaaagatagggctggtttacttccagtgggtattgtggctgttgaaggcagtttccatgaaagtgagtgcgtatcaattaaggtgattgccgaaagatcctctcctttatctgatggtcttgaagtaggaacctgcagagtgaattatagtgctattgaaataaacttaataaaaggtttacacagtagtgaaattgaaccagttttgggatttgctgatagtgagtacgttgcccatagagataatttggcattccagccaaccttaccaccttccactgaatccttatttgaaaataattag

SEQ ID NO: 397 - protein, 424 aa, Debaryomyces hansenii CBS767
MSDSKSYIIVIKLGTSSLVDEVTREPRIANMSLIVETIVKLRRQGHKIVLVSSGAIAFGMKRVGISSKPSKLAAVQALASIGQGRLIGLFDDLFRQMEQTIGQILLTRNDISDFNQYKNAKNTLHELLDMGVIPIVNENDTLSVAEIKFGDNDTLSAITAGMVHADYLFLMTDVQCLYTDNPRSNPDAEPILVVDKVDDLDVKTDTESGGSKVGTGGMTTKLIAAGLATNVGVTTIITLSSQPDSILSIVSNIQSMDKLDLSTEQQTRYIAGEIKKNKIPLHTRFLGLPRATKIISDKRFWLLHGIKTKGTLYIDHLCYEALTRKDRAGLLPVGIVAVEGSFHESECVSIKVIAERSSPLSDGLEVGTCRVNYSAIEINLIKGLHSSEIEPVLGFADSEYVAHRDNLAFQPTLPPSTESLFENN

SEQ ID NO: 398 - DNA, 1272 bp, Candida albicans SC5314
  CDS (1)..(1272): transl_table=12
atgacaaagcaattcaccatagtcattaaacttgggacctcatcccttgtagatgaggttaccagagaaccaagaatagccaacatgtcgcttatagtcgaaacgatggttagactacgccgccagggccacaaaatcgtcattgtctcgtctggggcaattgcatgtggaatgaaacaagttggattagaagaaaaacctgcaaatttatcagcagtgcaggctttggcttctatcggacaagtgcgacttattagaacctttgatgatttattccggcaattagaacaaccgatagcccagattttactcacaagaaacgacataatggacttcactcaatacaagaacgctcaaaatacattgaatgagttgatggatatggggatcattcctatagtcaatgaaaacgatacattatcagtttctgaaatcaagtttggtgataacgatagtttgtcggccatcacagccgggatcattcatgccgattatttgtttctcatgaccgacgtcgagtgtttgtataccgacaacccaagaaccaacccagacgcacaacctatattggtagtcgacaagattgatgatttgcatgtgaagactgataccgagtctggtgctggatctaaagtcgggactggtgggatgaccacgaaattgattgctgccgatttagcaaccaatgctggtgtgaccacgatcataacattatcgagtcaaccatattacattattgatattgttgcccatatacaggctcatgcagatacattatcggttgaaaaccagcgtcttgcgttacaaaaggatatccaacagggtaaaattccattgcatacaagatttttgagcaagccccaagatacattaatcaaatctgatcgcagattctggttattacatggattaaaaactaagggagcattagtcatcgaccaagggtgtttccaagcattgacaagacgtaatcgtgcaggattattaccggttggtatacttcatgttgtggggaattttcaccaaagtgaatgtgtatcgatcaaagttgtccctgataagaatggtgctattgatgatgcagttgaagtgggccattgcagagtaaattacctggccccagaaatcaccctaattaaaggtcataaaagtagtgaaattgaagcaattctaggttatgctgatagtgaatatgtggcacatagagataatttagcattcccaccagtcatgccaccttcaacagattcgttgatctcggatagtttatag

SEQ ID NO: 399 - protein, 423 aa, Candida albicans SC5314
MTKQFTIVIKLGTSSLVDEVTREPRIANMSLIVETMVRLRRQGHKIVIVSSGAIACGMKQVGLEEKPANLSAVQALASIGQVRLIRTFDDLFRQLEQPIAQILLTRNDIMDFTQYKNAQNTLNELMDMGIIPIVNENDTLSVSEIKFGDNDSLSAITAGIIHADYLFLMTDVECLYTDNPRTNPDAQPILVVDKIDDLHVKTDTESGAGSKVGTGGMTTKLIAADLATNAGVTTIITLSSQPYYIIDIVAHIQAHADTLSVENQRLALQKDIQQGKIPLHTRFLSKPQDTLIKSDRRFWLLHGLKTKGALVIDQGCFQALTRRNRAGLLPVGILHVVGNFHQSECVSIKVVPDKNGAIDDAVEVGHCRVNYSAPEITLIKGHKSSEIEAILGYADSEYVAHRDNLAFPPVMPPSTDSLISDSL

SEQ ID NO: 400 - DNA, 1236 bp, Propionibacterium acnes KPA171202
  CDS (1)..(1236): transl_table=11
gtgacctgcgcggagagtcgtggcgcgcccgtgttgccgaagaggagtggttcgagggccgtgactgatcagcgcggagccatatgcggggccgccaccctggtggtcaaggtcggatcttcctctttgactcttcctggtggcgggattgacgttcgtcgtgttgacgacctggttgatgcgctgagtgaggtcatcgcggtcggccggcgcgtcgtcctggtgagttccggggcgattgccaccggatttcccgccatggggataactcatcgtccgcgcactttggctggcaagcaagcggccgcgtcggtgggacaaggtattttactggctcactacgcgtcgaggtttgccagtcacgggttgcgggtggggcaggtactactcaccgtcaatgacctggtgcggcccacctcgtaccgcaatgcctggtcaaccctcgacactttgctggggttgggcgtcgtgccgatcgtcaacgagaacgacacggtcgccaccggagaaattcggtttggcgataatgatcggcttgctgccctggtagccgagctggtgcgcgctcaagccctcatcctgctctctgacgttgacgccttgtacaccgcccatccggattcaccggatgctcgtcgcgtggaggttgtggaggacatcgacacattggatgtcgatacccataaagctggttcgggggtgggaaccggcggcatgaccacgaaacttgaagccgcccgaatggccacctgtgccggggtaccggtggtactcgcagcggcggtggatgccccggacgttctggctggtgtccccgtgggtacctacttccgcccgctggcgacgcgacggccccgacggttgctgtggttggccgacgctgccaccccgcagggacagatcgtcatcgacgacggagctgtcgaagctttgacacagcgtcattcctcgttgttggcggtgggtgtgactcgggtacacggggatttccaagcaggcgacccagtgacgatcctggcctccgacggtcgagttgttggtcgcggtatcgcccagttctcccatgatgaggtgcgcgtcatgaggggacgttcgagtgcctggctggccgcagaaatgggtccggcggcctctcgcgagatcatccaccgcgatgccatggtgctgagtcgtcgtcgtaaagctgagccgtcgtcgaggaaccagaaaagtagcgggtcaagggtgacgtcctga

SEQ ID NO: 401 - protein, 411 aa, Propionibacterium acnes KPA171202
MTCAESRGAPVLPKRSGSRAVTDQRGAICGAATLVVKVGSSSLTLPGGGIDVRRVDDLVDALSEVIAVGRRVVLVSSGAIATGFPAMGITHRPRTLAGKQAAASVGQGILLAHYASRFASHGLRVGQVLLTVNDLVRPTSYRNAWSTLDTLLGLGVVPIVNENDTVATGEIRFGDNDRLAALVAELVRAQALILLSDVDALYTAHPDSPDARRVEVVEDIDTLDVDTHKAGSGVGTGGMTTKLEAARMATCAGVPVVLAAAVDAPDVLAGVPVGTYFRPLATRRPRRLLWLADAATPQGQIVIDDGAVEALTQRHSSLLAVGVTRVHGDFQAGDPVTILASDGRVVGRGIAQFSHDEVRVMRGRSSAWLAAEMGPAASREIIHRDAMVLSRRRKAEPSSRNQKSSGSRVTS

SEQ ID NO: 402 - DNA, 1086 bp, Mannheimia succiniciproducens MBEL55E
  CDS (1)..(1086): transl_table=11
gtgaaattcggtaccagcacattaactcaaggtacgccaaaattaaatcgcgcccacatgatcgaaatcgtgcgtcaattggcgcaattacatcaggaaggttatcgtcttgtaattgtcacatccggcgcaatggcggcgggcaggcattatcttaatcacccgaaacttccgcccacaatcgcctcaaaacaattattggcggcggttggacaaagccagctgattcaaacgtgggaacaactatttgccatttacgatattcatatcggtcagcttttattaacccgcgccgatattgaagaccgcgaacgctttttaaatgccagagatacgcttcacgcgttattggataaccgcattattccggtcgtaaatgaaaacgacgccgtcgccaccgcagaaatcaaagtaggcgataacgacaacttatcggcgttagtggcgattttagtacaggcggaacaactttatttgctcaccgaccaacaaggattatttgactccgatccgcggaaaaatccacaggcaaagctaatcccggtggtaaatgaaattaccgatcatattcgttctattgccggcggtagcggtacaaccttaggcacaggcggaatgtccaccaaaattaccgccgccgacattgcaacccgttccggcattgaaacaatcattgctccgggaaacagggaaaatgttatcgccgatcttgcccacggcgaagctataggtacgaaatttacggttcagaccgataaactggaaagccgtaaacaatggctctttgccgcgccttccgccggcattctgaccatcgatcaaggggcggaaaatgcaatattagaacaacataagtctttattgccggcgggtattgtaaatattgaaggtcgtttctcccgcggagaagtggtaaaaatccgcacccaacaaggcaaagatatcgcccttggcatgccgcgttacaacagcgatgcgctttatctcattcaaggcaaaaaatctcagaatattgaaaaaattctgggttatgaatacggctctgtggcgattcaccgcgatgatatgatcgtgttaaacaaataa

SEQ ID NO: 403 - protein, 361 aa, Mannheimia succiniciproducens MBEL55E
MKFGTSTLTQGTPKLNRAHMIEIVRQLAQLHQEGYRLVIVTSGAMAAGRHYLNHPKLPPTIASKQLLAAVGQSQLIQTWEQLFAIYDIHIGQLLLTRADIEDRERFLNARDTLHALLDNRIIPVVNENDAVATAEIKVGDNDNLSALVAILVQAEQLYLLTDQQGLFDSDPRKNPQAKLIPVVNEITDHIRSIAGGSGTTLGTGGMSTKITAADIATRSGIETIIAPGNRENVIADLAHGEAIGTKFTVQTDKLESRKQWLFAAPSAGILTIDQGAENAILEQHKSLLPAGIVNIEGRFSRGEVVKIRTQQGKDIALGMPRYNSDALYLIQGKKSQNIEKILGYEYGSVAIHRDDMIVLNK

SEQ ID NO: 404 - DNA, 1122 bp, Pseudomonas fluorescens PfO-1
  CDS (1)..(1122): transl_table=11
atgatgcggagcaaggtgacaggtgcgcagcgttgggtcgtgaagatcggcagcgctttgctgacagcggatggcaaagggctggatcgcacggcaatgggtgtctgggtcgagcagatggtggctctgcatgaggctggcgtcgagctggtgctggtgtcctccggggcggtggcggcaggcatgagtcgcctgggctggactgcgcgacccagtgcgatgcatgagctccaggctgccgctgcaatcggtcagatgggtctggtgcaagcctgggaatcgagctttgccgagcatggccggcacaccgcgcagattcttctgactcacgacgacctgtccgatcgcaagcgttacctgaacgcccgcagcaccttgcgtgcgctggtcgagctgaaagtcatcccagtgatcaacgagaacgacaccgtggtcactgacgaaatccgcttcggcgacaacgacacgctcgcggcgctggtggccaacctggtcgaggctgatctgctggtgatcctgacggatcgcgacggcatgttcgacgccgatccgcgcagtaaccctgacgcccaactgatttacgaagcgcgcgccgatgatccgacactggatgcggtggcgggcggtactggcggtgcattgggtcgtggcggcatgcagaccaagctgcgcgcggcgcggctggcggcacgttccggggcgcataccatcattgttggtgggcgtctggagcgcgtgcttgatcgtctgaaggcgggcgagcgcatcggtacgctgctgtcgcctgagcgcggcatgctcgcggcgcgcaagcagtggctggccgggcatctgcaaacccgtggcacgctggtgctggatgatggcgcggtttctgcgttgtcccagggcaacaaaagtctgctgccggtcggcgtcaaactggttcagggcagtttccgtcgcggcgaaatggtggtttgcgtggcgccggacggtcgtgagatcgcccgcggcctggcgaactacagtgctctggaagcacaaaaaatcatcggtcagtcgtcagatgcgattgtcggtttgctgggttacatggctgagccggaactggttcatcgtgacaacctgattctggtgtaa

SEQ ID NO: 405 - protein, 373 aa, Pseudomonas fluorescens PfO-1
MMRSKVTGAQRWVVKIGSALLTADGKGLDRTAMGVWVEQMVALHEAGVELVLVSSGAVAAGMSRLGWTARPSAMHELQAAAAIGQMGLVQAWESSFAEHGRHTAQILLTHDDLSDRKRYLNARSTLRALVELKVIPVINENDTVVTDEIRFGDNDTLAALVANLVEADLLVILTDRDGMFDADPRSNPDAQLIYEARADDPTLDAVAGGTGGALGRGGMQTKLRAARLAARSGAHTIIVGGRLERVLDRLKAGERIGTLLSPERGMLAARKQWLAGHLQTRGTLVLDDGAVSALSQGNKSLLPVGVKLVQGSFRRGEMVVCVAPDGREIARGLANYSALEAQKIIGQSSDAIVGLLGYMAEPELVHRDNLILV

SEQ ID NO: 406 - DNA, 1113 bp, Haemophilus somnus 129PT
  CDS (1)..(1113): transl_table=11
atggaaacacaaaaaacaaataaaaccattgtggtaaaatttggtaccagcaccttaacgcaaggttcatcaaaattaaatcgccctcacatgatggaaattgtgcgtcaaatcacacagttgcatcgagcaggctttcgtataattattgttacctccggagcgatggcagcggggcgacattatctcaatcatccgcaacttcctccaacaattgcctcaaagcaattactagcagcagtaggacaaagtcaactcattcaaacgtgggaacaacttttcgctatttatgatattcatattgggcaaattctgttaactcgagcggacattgaagatcgtgaacgttttatgaacgcaagagatacgttacatgctttattagataaccgaattattccggtaattaatgaaaatgatgcggttgcaaccgctgaaattaaagtgggggataatgacaacctttctgcattagtggctattttggcacaagcggaacaactctacttgctaacagatcaacgtggattatttgatagtgatccaagaaaaaatcctcaagcaaaactgatttccatagtcgataaaattactgatcatatccgctctattgcaggaggaagtgggacaacgttagggacgggaggaatgacaacaaaaattagtgctgctgacatagcgactcgttccggtgttgaaaccattattgcaccgggtaatcttgaaaatgtcatcgtcaatttggcttatgggaaagaaatcggcacaaaatttgttgtgcagacagattgcttggaaagccgtaaacagtggctctttgctgcaccggttgcaggtatagtaactattgatgagggagcggaaagtgcggtattgattcagcataaatctctattacctgcaggtattatcagcgttgaaggatgtttttctcgtggtgaagttgttaaaatttgtggcacgaacggtaaaaaaattgctttgggcgtacctcgctataacagcgattctctcatacaaataaaaggaaaaaaatcgcaagatattgaacagatcctcggttatgaatatggttctgttgctattcatcgtgatgatatggtcgtttattaa

SEQ ID NO: 407 - protein, 370 aa, Haemophilus somnus 129PT
METQKTNKTIVVKFGTSTLTQGSSKLNRPHMMEIVRQITQLHRAGFRIIIVTSGAMAAGRHYLNHPQLPPTIASKQLLAAVGQSQLIQTWEQLFAIYDIHIGQILLTRADIEDRERFMNARDTLHALLDNRIIPVINENDAVATAEIKVGDNDNLSALVAILAQAEQLYLLTDQRGLFDSDPRKNPQAKLISIVDKITDHIRSIAGGSGTTLGTGGMTTKISAADIATRSGVETIIAPGNLENVIVNLAYGKEIGTKFVVQTDCLESRKQWLFAAPVAGIVTIDEGAESAVLIQHKSLLPAGIISVEGCFSRGEVVKICGTNGKKIALGVPRYNSDSLIQIKGKKSQDIEQILGYEYGSVAIHRDDMVVY

SEQ ID NO: 408 - DNA, 1110 bp, Trichodesmium erythraeum IMS101
  CDS (1)..(1110): transl_table=11
atgaatacaatagtgatcaaaataggcacttctagcctaactaattcagaaaccggaaatttagccttatctacaatttctagcttaattgaaactattatcaatttacgtcagcagggatatcaagtagttttagtatcttctggagctgttggtgtaggttgcgatatattaggactaaccaaaaagcctcgaaatatttctatgaaacaagccatagcagcagtaggtcaaggacaaataatgcgagtttacaatgacttgttttcatctttgcaacaaacagttgcccagattttattaacaaaaagtgacctgtcacgacgtagtagttatgtcaatgcctacaacacatttcaacaactttttcgactaggtgtagtcccaatagtgaatgaaaatgataccactgctgttgaagagctaaattttggggacaatgatactctatcagctttagttgccagtctagtagaggctgattggttattcatactaactgatgtcgatagattatactccgccgacccgagaaaaaatccagatgctttacccattaccttagtaggggaaatagaacaactcaaagaacttaaagttcaagttggagagtctgttagtggacgaggaactgggggaatggttacaaaaattgaggctgctaaaattgctacttctgctggagtccgaactgtaattactgatggtaaagtacccactaatatacaaaaaatcctcaatggagaatctataggtactcagtttgaacctcaaccagaacaagtcaatggtcgcaaacattggattgccaatgttttagttccagcaggccaactatatctagaccaaggtgcagttaaggcaatttctgagtatggtaaatctctattagctgctggtattattcaagtagaaggagaatttaattcatcggatgctgtcaaactatgcaatgaaaaaggccaggaaatagctaggggacttgtgaactacagcagtattgaattgcaaaaaattctaggttgtcgctcagaaaatatatctgatattttgggctatgtgggagctgaaacagttgtacatagaaataatcttttgctgacaaattaa

SEQ ID NO: 409 - protein, 369 aa, Trichodesmium erythraeum IMS101
MNTIVIKIGTSSLTNSETGNLALSTISSLIETIINLRQQGYQVVLVSSGAVGVGCDILGLTKKPRNISMKQAIAAVGQGQIMRVYNDLFSSLQQTVAQILLTKSDLSRRSSYVNAYNTFQQLFRLGVVPIVNENDTTAVEELNFGDNDTLSALVASLVEADWLFILTDVDRLYSADPRKNPDALPITLVGEIEQLKELKVQVGESVSGRGTGGMVTKIEAAKIATSAGVRTVITDGKVPTNIQKILNGESIGTQFEPQPEQVNGRKHWIANVLVPAGQLYLDQGAVKAISEYGKSLLAAGIIQVEGEFNSSDAVKLCNEKGQEIARGLVNYSSIELQKILGCRSENISDILGYVGAETVVHRNNLLLTN

SEQ ID NO: 410 - DNA, 1119 bp, Shewanella sp. MR-4
  CDS (1)..(1119): transl_table=11
atgaatttaagtgagatagcgtatcgccgcgtggtagtgaagttagggacgagtgtgctgacttctggcagtaaacagctggataaagcccatatggttgagcttgctcgtcaaatggccgcactgatgagatcaggggtcgaagtcgtattatgcacttctggcgcaattgccgccggacgcgaacatctccaatacccggtattgcccgacactatggctaacaaacagttattagccgctgtcgggcagagtcagcttattctcgcttgggcacaactctttagtatctatggtttgcatgtggggcaattgctgctaacccgtgccgatctacacgatagagagcgctatttaaatgcccgcgatacgcttaatgccttgctggcaaacaatattatccccatcatcaacgaaaacgatgccgtcgctactaatgagatcaaagtgggcgacaacgataacttgtcggcgcgtgctgcactgctgtgtgatgccgacctgttgattttgttgacggatcaaaagggcttattcgatgccgatccgcgcactaacccgaatgctaagctgatttctcaggtcgagaaaattgatgacagtctgcgtctgttagcgggtggttcggtgtcgggcttaggtacgggcggaatgtcgactaagctagaagctgcggatattgctcgccgtgcgggcattgaagtggtgattgcctcgggtcatcaccccgatgtgattaaaaaagtcgtcggcaaagaatctgtcggcacgcattttagtgccatcgaaaatccgttagagagccgcaaacagtggattttagcgggacccgccgctcaaggttcattggtgctcgatgcgggcgcggtgaaagccgtgaccgaaaaaggtcgcagcctgctctctaaggggattattggcgtaaaaggtgaatttgaacgtggtgcaaccctgcaattggttgaccaaaaaggcaaaatcattgccagaggcatcacccgttactgtggtgaggccttaggggtaattgcgggtaaacattccgacgaaatcgagtcagtgctcggttacgattatggtgacgcaatagtgcaccgcaacgacatggtcgtcttataa

SEQ ID NO: 411 - protein, 372 aa, Shewanella sp. MR-4
MNLSEIAYRRVVVKLGTSVLTSGSKQLDKAHMVELARQMAALMRSGVEVVLCTSGAIAAGREHLQYPVLPDTMANKQLLAAVGQSQLILAWAQLFSIYGLHVGQLLLTRADLHDRERYLNARDTLNALLANNIIPIINENDAVATNEIKVGDNDNLSARAALLCDADLLILLTDQKGLFDADPRTNPNAKLISQVEKIDDSLRLLAGGSVSGLGTGGMSTKLEAADIARRAGIEVVIASGHHPDVIKKVVGKESVGTHFSAIENPLESRKQWILAGPAAQGSLVLDAGAVKAVTEKGRSLLSKGIIGVKGEFERGATLQLVDQKGKIIARGITRYCGEALGVIAGKHSDEIESVLGYDYGDAIVHRNDMVVL

SEQ ID NO: 412 - DNA, 1143 bp, Alkalilimnicola ehrlichei MLHE-1
  CDS (1)..(1143): transl_table=11
atgagtcgcggtatgcgcgagcggctgccccatgccatccggtgggtggtgaaggtggggagcgccctggtgaccagcgatggtcagggggtggcccgcggggccatccagggctgggcgagcgaagtggtcgggctgcgccgcggcgggcgccaggccacgctggtctcctccggtgctgtggccgagggcatgagtcggctgggctggtcgcagcggccgaacgcgctctaccagttgcaggccgccgctgcggtgggtcagatgggggtggtagaggcctgggagagcggctttcgtgccgaagggttgcgcaccgcccaagtgctgctgacccacgatgacctggccaaccgccgccgctacctgaatgcccggaccaccctgcgtgagctgctgcgcctgggcgtggtgccggtggtgaacgagaacgataccgtggtcaccgatgagatccgcttcggcgataacgacacccttgcggcgctggtggccaatctggtggaggcggacgtgctggtgatcctgaccgatcaggagggcctgtacgatgcggatccgcgcaggcacccggaggcgcggctgatccgcgaggcctcggccgaggatccggggctggagcggtactgcggcagtggcggcggcgcgttggggcggggcggtatgctcaccaaggtgcaggcggcggctcgcgcggcccgctcggggtgcatcaccgtgatcgcctcggggcgcgagcgcgacgtgctcgcccgtatcgctgccggtgaacgcctgggcaccctgctgtacccagagcgcgagccggtggcggcccgcaagcagtggctcgccagccatctgcggctgcgcggccggctctggctggatgagggtgcggcccgggtgctgcgcgaggcggggagcagcctgctgccggtcggcgtgacgcgggtggagggtcggttctcccgcggggagatggtggcctgtctggcgcctgacgggcgggaggtggcccgggggctggtcaactacagcgccaaggaggcgcgtcagatcctcgggcggcccagccgggagatccagtccatcctgggctacgtggatgaaccggagctgattcaccgggacaacatggtggtcaccgccgacggcggctga

SEQ ID NO: 413 - protein, 380 aa, Alkalilimnicola ehrlichei MLHE-1
MSRGMRERLPHAIRWVVKVGSALVTSDGQGVARGAIQGWASEVVGLRRGGRQATLVSSGAVAEGMSRLGWSQRPNALYQLQAAAAVGQMGVVEAWESGFRAEGLRTAQVLLTHDDLANRRRYLNARTTLRELLRLGVVPVVNENDTVVTDEIRFGDNDTLAALVANLVEADVLVILTDQEGLYDADPRRHPEARLIREASAEDPGLERYCGSGGGALGRGGMLTKVQAAARAARSGCITVIASGRERDVLARIAAGERLGTLLYPEREPVAARKQWLASHLRLRGRLWLDEGAARVLREAGSSLLPVGVTRVEGRFSRGEMVACLAPDGREVARGLVNYSAKEARQILGRPSREIQSILGYVDEPELIHRDNMVVTADGG

SEQ ID NO: 414 - DNA, 1116 bp, Hyphomonas neptunium ATCC 15444
  CDS (1)..(1116): transl_table=11
atgactgctgacaccctctcccgcgccaagcgcatcgtcgtgaaaaccggctctgccctcatcgcggaggcaggcgctccgcgccgcgaatggctcgccgccctcgccgcagacatcgccgccctgcgccagcgcggcaaggaagtcatcctcgtctcctccggcgccgttgcccttggccgctcagccctcggcgcgccctatcaaggccgcctggaacagaaacaggccgccgccgccatcggccagccccggctcatggccgcgctgggagacgccctcgccccccacgccatcgcctgcggccaggccctcctcacccccggcgacaccgaaaatcgccgcagatggctgaatgcccgcgccacgctggaaaccctgctggaagccggtgtcgtccccgtcatcaacgagaacgataccgtcgccaccgaagaaatccgctacggggataatgaccgcctcgccgcccgcgtcgcccagatgatggccgctgatgtcctgatcctcctctcggacatcgacggcctctacaccgcagacccgcgctcaaaccccggcgccccccacatccccttcctcgaagcgctcacccctgagcatgacgccatggccaccggcgccaacgccgccgccggtgtcggctccggcggcatggccaccaaactcgccgccgcccgcatcgcccatgcggcgggctgctccaccctcatcacgctcggcaaccgcccccaccccctcggcgccatcgaggccggcgaacgcgccaccctcatcgcctcccgcatcagccccgccaaggcccgcgccgcctggctcgaaggccacctcaagcccgaaggcgaactcctcatcgatgacggcgccgccgccgcgctggcaaaaggcgcgagcctcctcgccgtcggcgtgcgcggcgtcaccggccagttcgagcgcggcgccgccgtcgccatccgcgcccccgatggccgcatcatagccaagggcgtcaccgcctacggcaccgaagacatccgccgcatcgccggccgccgcaccgaagacgccgaagccatcctcggctatcgcggccgccccgccatcatccaccgcgacgacatggtgcgcctttga

SEQ ID NO: 415 - protein, 371 aa, Hyphomonas neptunium ATCC 15444
MTADTLSRAKRIVVKTGSALIAEAGAPRREWLAALAADIAALRQRGKEVILVSSGAVALGRSALGAPYQGRLEQKQAAAAIGQPRLMAALGDALAPHAIACGQALLTPGDTENRRRWLNARATLETLLEAGVVPVINENDTVATEEIRYGDNDRLAARVAQMMAADVLILLSDIDGLYTADPRSNPGAPHIPFLEALTPEHDAMATGANAAAGVGSGGMATKLAAARIAHAAGCSTLITLGNRPHPLGAIEAGERATLIASRISPAKARAAWLEGHLKPEGELLIDDGAAAALAKGASLLAVGVRGVTGQFERGAAVAIRAPDGRIIAKGVTAYGTEDIRRIAGRRTEDAEAILGYRGRPAIIHRDDMVRL

SEQ ID NO: 416 - DNA, 1203 bp, Rhizobium leguminosarum bv. viciae 3841
  CDS (1)..(1203): transl_table=11
atgagggcgaggacaagggtggagacgagggcgatgaccagccgtaagccgcttggccgctaccgccgcatcgtcatcaagatcggatccgcgcttctggtcgaccgcaaggccgggctgaagaaggcctggctcgacgccatgtgcgccgatatctccggcctgaaggccaagggtatcgacgtgctcgtcgtgtcctcgggcgcaatcgcgctcggccgctcggtgctcgacctgccctccggcgcgctgaagcttgaggaaagccaggcggcggcggccgtcggccagatcgcgctggcccgcgcctggtcggaaagcctgtcgcgcgacgagatcgtcgccggccagatcctgctgacgctcggcgataccgaggagcgccgtcgctatctcaatgcgcgcgccaccatcaatcagcttttgaagatcggcgccgtgccgatcatcaatgaaaacgacacggtcgccaccagcgagatccgctacggcgacaacgaccggctggccgcccgcgtcgcgacgatgaccggcgccgatctgctcattcttctctccgatatcgacggtctctacaccgcgccgccccatctcgatccgaacgcaacgttccttgagacgattgctgaaatcacccccgagatcgaggcaatggccggaggcgcggcctccgagctttcgcgtggcggcatgcgtaccaagatcgatgccggcaagattgcgacggcatcaggctgcgcgatgatcatcgcctccggcaagaccgagaaccctctgtcggcgatcgaaaacggcgcgcgttcctcctggtttgcgccgtcgggcacacccgttaccgcccgcaagacctggattgccggacagctgcagccggccggcgaactgcatgtcgatgacggcgccgtcacagccctcggcgccggcaagagcctgcttcccgccggcgttcgcagcgtttccggcctcttcagccgcggcgacacggtggcgatcatcggcccggccggccgcgagatcgcccgcggcctggtaagctacgatgccgacgacgcccgtcggattgccggccgcaagtcggcggagatcgagaccattctcggttatcccggacgcgccgccatggtccatcgcgacgacatggtgatgaccgcgcagatcggttcgaaatcggaaaggcagaagaaggacgcgagctatgcttga

SEQ ID NO: 417 - protein, 400 aa, Rhizobium leguminosarum bv. viciae 3841
MRARTRVETRAMTSRKPLGRYRRIVIKIGSALLVDRKAGLKKAWLDAMCADISGLKAKGIDVLVVSSGAIALGRSVLDLPSGALKLEESQAAAAVGQIALARAWSESLSRDEIVAGQILLTLGDTEERRRYLNARATINQLLKIGAVPIINENDTVATSEIRYGDNDRLAARVATMTGADLLILLSDIDGLYTAPPHLDPNATFLETIAEITPEIEAMAGGAASELSRGGMRTKIDAGKIATASGCAMIIASGKTENPLSAIENGARSSWFAPSGTPVTARKTWIAGQLQPAGELHVDDGAVTALGAGKSLLPAGVRSVSGLFSRGDTVAIIGPAGREIARGLVSYDADDARRIAGRKSAEIETILGYPGRAAMVHRDDMVMTAQIGSKSERQKKDASYA

SEQ ID NO: 418 - DNA, 1134 bp, Magnetococcus sp. MC-1
  CDS (1)..(1134): transl_table=11
atgcgtgaggctacggaggcgtggcagcgtgtggcggctgcccagcggatagtggttaagattggttcaaacttgctgaccaccaaggatggggtgtgcgaggattggattgcggcccgttgtgcggagattgcggcattgatgggtcgtggcaagcaggttgtggtggtcacgtcgggctcggttgcggcgggggcgtcgcgtttgggtttggggcggcgtccggcaacactgccagagaagcaggcggcggcggcggcgggtcagggcaagttgatgcagatttatgagcaggcttttaacacccatggtttgcatacggggcagatattattaacgcgggatgatgtggcgaaccggcgtcgttatttgaatgcgcgggatacgttggagaccttattaaccttgggtttggtgccggtggttaatgagaatgacacggtggtggtggaggagattcggtttggtgacaatgataccctggcggcgttggtggcgggtttggtagaggctgagctgttggttttgttatcggatgtggatggtttatacagtgcggatccccgtaaggatgagagggcgcagcgtattgagttggtggtggaggtaacgccggagattgaggctttggcgggtggtaccggttcggaggttggctctgggggtatggtaacgaagttacgggcggcgaagatggcggcgcgtacggggtgtatgacggtgttggccaatggttttcaggcggatcctatcggggcggtgatggggggtggtgttggtacgctctttttatcgttgggggatgccattagcagccgcaagcgttggattgccaatggtttaacgtgtgagggtagtctatttttggacgagggggcggttgcggctttattaaagggcaagagtctcttagcgcggggtgtggtggcggttgagggtgtgtttgatcggggtgcggcgctctattgttgtgatgtgcaggggcggcggattgccaaggggttggtgaattatcgcagtgatcatatggagcagattaagggtaagcatagttgggagattgaggcggccttgggttttattattgatgaagaggtgatgcatcgggatgacatggtgcagttggtcaagtag

SEQ ID NO: 419 - protein, 377 aa, Magnetococcus sp. MC-1
MREATEAWQRVAAAQRIVVKIGSNLLTTKDGVCEDWIAARCAEIAALMGRGKQVVVVTSGSVAAGASRLGLGRRPATLPEKQAAAAAGQGKLMQIYEQAFNTHGLHTGQILLTRDDVANRRRYLNARDTLETLLTLGLVPVVNENDTVVVEEIRFGDNDTLAALVAGLVEAELLVLLSDVDGLYSADPRKDERAQRIELVVEVTPEIEALAGGTGSEVGSGGMVTKLRAAKMAARTGCMTVLANGFQADPIGAVMGGGVGTLFLSLGDAISSRKRWIANGLTCEGSLFLDEGAVAALLKGKSLLARGVVAVEGVFDRGAALYCCDVQGRRIAKGLVNYRSDHMEQIKGKHSWEIEAALGFIIDEEVMHRDDMVQLVK

SEQ ID NO: 420 - DNA, 1119 bp, Shewanella sp. ANA-3
  CDS (1)..(1119): transl_table=11
atgaatttaagtgagattgcgtatcgccgcgtggtagtgaagttagggacgagtgtgctgacgtctggcagtaaacagctagataaagcccatatggttgagcttgctcgtcaaatggcagcactgatgagatcaggggtcgaagtcgtattatgcacttctggcgcaattgccgccggacgcgaacatctccaatacccggaattgcccgacactatggccaataaacagttattagccgctgtcgggcagagtcagcttattctcgcttgggcacaactctttagcatctatggtttgcatgtggggcaattgctgctgacccgtgctgacctacacgatagagagcgatatttgaatgcccgcgatacgcttaatgccttgctggcaaacaatattatcccaatcatcaacgaaaacgatgccgttgctactaatgagatcaaagtgggcgacaacgacaacttgtcggcgcgtgcggcactgctgtgtgatgccgacctgttgattttgttgacggatcaaaagggcttattcgatgccgatccgcgcactaaccctaatgctaagctgatttcgcaggtcgagaaaattgacgacagtctgcgcctgttagcgggtggttcggtttctggcttaggtacgggcggaatgtcgactaagctagaagctgcggatattgctcgccgcgcgggtattgaagtggtgattgcctcgggtcatcaccccgatgtgattaaaaaggttgtcggcaaagaatctgtcggcacgcattttagtgccatcgaaaatccgttagagagccgcaaacagtggattttagcgggacctgccgcccaaggttcactggtgctcgatgcgggcgcggtgaaagccgtgaccgaaaaaggtcgcagcttgctctctaaggggattattggcgttaaaggggaatttgaacgtggtgcaaccctgcaattggttgaccaaaaaggcaaaatcattgccagaggcatcacccgctactgtggtgaggccttagggttaattgcgggtaaacattccgacgaaatcgagtcagtgctcggttacgattatggtgacgcaatagtgcaccgcaacgacatggtcgtcttataa

SEQ ID NO: 421 - protein, 372 aa, Shewanella sp. ANA-3
MNLSEIAYRRVVVKLGTSVLTSGSKQLDKAHMVELARQMAALMRSGVEVVLCTSGAIAAGREHLQYPELPDTMANKQLLAAVGQSQLILAWAQLFSIYGLHVGQLLLTRADLHDRERYLNARDTLNALLANNIIPIINENDAVATNEIKVGDNDNLSARAALLCDADLLILLTDQKGLFDADPRTNPNAKLISQVEKIDDSLRLLAGGSVSGLGTGGMSTKLEAADIARRAGIEVVIASGHHPDVIKKVVGKESVGTHFSAIENPLESRKQWILAGPAAQGSLVLDAGAVKAVTEKGRSLLSKGIIGVKGEFERGATLQLVDQKGKIIARGITRYCGEALGLIAGKHSDEIESVLGYDYGDAIVHRNDMVVL

SEQ ID NO: 422 - DNA, 1113 bp, Mycobacterium smegmatis str. MC2 155
  CDS (1)..(1113): transl_table=11
gtgagcgagcaccgcgaggcggtccgtaccgcacgcagtgtcgtcgtcaagatcggaaccacggccctcaccacaccttcgggtgtcttcgacgccaaccggctcgcaagcctggtcgaggccatcgagggccgcatgaaagccggctccgacgtcgtcatcgtgtcctctggtgccatcgccgccggtatcgaacctctcgggttgtccaagcgcccaacggatctcgcgaccaagcaggccgcggccagtgtgggccaggtggccctggtgaacgcgtggagcgcggcgttcgcggtgtacaaccgcaccgtcgggcaggtcctgctcactgcgcacgacatctcgatgcgtgtgcagcacaacaacgcccagcgcaccctcgaccgtctgcgagccctgcacgccgtggcgatcgtcaacgagaacgacaccgtggccaccaacgagatccgcttcggtgacaacgaccggctctcggctttggtggcgcacctggtcggggccgacgcgctgatcctgctgtcggacatcgacggcctctacgacggagacccccgcaaggcgacgcccgacaaaccggcccgcttcataccggaggtcgccgcccaaggtgacctcgatggcgtggtcgcgggccgcggcagcagcctcggcacgggcggtatggcatcgaagttgtcgtcagctctgctggccgccgacgcgggtgttcccgtgctgctggccgccgcggcggacgccggccgagcgctcgacgatgcgtcggtgggcacggtgttcgccccgcgccccgagcgcatgtcggcccgcaagttctggatgcggtacgccgcggagtcggccggtgcgctcaccctcgacgacggcgcggtgcgcgcggtgatcaagcagcgccgctcgctgctgcccgcgggcatcacctcggtgaccggccgcttccacggcggcgacgtggtcgacctgcgagcgctcgacgggcacaccgtcgcgcgcggcgtggtggcgtacgaccaggccgaactcgcctcgatcatcggccgctcgacacacgaactgcccgtcgagatgcgccgtcccgccgtccacgccgacgacctggtgcgcacctag

SEQ ID NO: 423 - protein, 370 aa, Mycobacterium smegmatis str. MC2 155
MSEHREAVRTARSVVVKIGTTALTTPSGVFDANRLASLVEAIEGRMKAGSDVVIVSSGAIAAGIEPLGLSKRPTDLATKQAAASVGQVALVNAWSAAFAVYNRTVGQVLLTAHDISMRVQHNNAQRTLDRLRALHAVAIVNENDTVATNEIRFGDNDRLSALVAHLVGADALILLSDIDGLYDGDPRKATPDKPARFIPEVAAQGDLDGVVAGRGSSLGTGGMASKLSSALLAADAGVPVLLAAAADAGRALDDASVGTVFAPRPERMSARKFWMRYAAESAGALTLDDGAVRAVIKQRRSLLPAGITSVTGRFHGGDVVDLRALDGHTVARGVVAYDQAELASIIGRSTHELPVEMRRPAVHADDLVRT

SEQ ID NO: 424 - DNA, 1116 bp, Azoarcus sp. BH72
  CDS (1)..(1116): transl_table=11
atgagagacaagatcaagaatgcgcgccggcttatcgtgaaagtcggcagcgccctcgtgaccaacaacggcgcggggctggatcctgccgcactcgacgactgggcgcgacagatcgccgcgctgcgtgcgcggggccgcgagatcgtgctggtgtcctcgggcgcgatcgccgccggcatgcagcgcctggggtgggtcaagcggccgcacgagatgcaccggctgcaggccgccgccgccgtgggtcagatggggcttgtggaggcttatgaaaaggcgttctcgcgccacggcctgcagactgctcagatcctgctcacccacgaggacctcgccgaccgcacgcgctatctgaatgcgcgctccacgctcgtcacgctgctggaactgggcgtcgtcccgatcatcaacgagaacgacacggtcgtcaccgacgagatcaagttcggcgacaacgacaccctcggcgccctggtcgcgaatctggtggaagccgacacgctgatcatcctcaccgaccagcgcggcctgtacaccgccgacccgaggcgtgacccgggtgcgacgctgatcagcgagggacgcgctgaggacaggcagtacgaagccatggcgggcggcgctggcagcggcatcagcaagggcggcatgatcaccaagatccgcgcggcgcagcgtgccgcccgcagcggcgcgcacacctgcattgccagcgggcgggaaaccgacccgctgctgcgtctggccgacggtgaagcggtgggcacgctgctctatgccgacagcacgccgctgcaggcccgcaagcagtggctggccgaccacctgcaactcgcgggcagcctgatcgtcgatgccggcgccgcgcgcgccctggatgacggccgcagcctgctgccggtcggcgtcgtcgaggtgcagggcgagttcaaacgcggggccgcggtcgcctgtcgcgacgaacacggcaccgaactcgcgcgcggcctggtcaattacagcagcgcggaatgccgtcgcatcctgcgccgcccgaccagcgacatcgagcaactgctcggctacatcgacgagcccgaactcatccatcgcgacaacctggtcatccgctag

SEQ ID NO: 425 - protein, 371 aa, Azoarcus sp. BH72
MRDKIKNARRLIVKVGSALVTNNGAGLDPAALDDWARQIAALRARGREIVLVSSGAIAAGMQRLGWVKRPHEMHRLQAAAAVGQMGLVEAYEKAFSRHGLQTAQILLTHEDLADRTRYLNARSTLVTLLELGVVPIINENDTVVTDEIKFGDNDTLGALVANLVEADTLIILTDQRGLYTADPRRDPGATLISEGRAEDRQYEAMAGGAGSGISKGGMITKIRAAQRAARSGAHTCIASGRETDPLLRLADGEAVGTLLYADSTPLQARKQWLADHLQLAGSLIVDAGAARALDDGRSLLPVGVVEVQGEFKRGAAVACRDEHGTELARGLVNYSSAECRRILRRPTSDIEQLLGYIDEPELIHRDNLVIR

SEQ ID NO: 426 - DNA, 1113 bp, Magnetospirillum magnetotacticum MS-1
  CDS (1)..(1113): transl_table=11
atgaaccaactggccgccgccaaacgcctgatcgtcaagatcggctcctcgctgctggtggatgaatccaccggtcaggtgaggcgcggctggctggagaccgtggccgccgacatcgccgcctgcaaggcgcgcggccaagaggtgatcgtggtgtcctcgggggccgtggcggtgggtcggcgcaagctgggcctgaccccgcccctcaaattggaagaaaagcaggccgccgccgcgacggggcagatccggctggcccatgcctggcaggatgccctggctcatcactccatcaccgtggcccaggtgctcctcacgctcgacgattccgagaacaggcggcgttacctcaatgcgcgctcgacgctggagaccctgctgcgccttggggccgtgccggtgatcaacgagaacgacacggtggccaccgccgaaatccgggtcggcgacaatgaccggctggcggcgcgcgtggcccagatggtttccgccgacgccctggtgctgttctccgatatcgacggactctataccaatgatccgcgcaaggacccgacggcccgtttcattcccgaggtgcacgaactgacgcccgagatcgaggccatggcgggcgatcccggctcggcctatggctcgggcggcatggtcaccaagctggtggcggcgcgcatctgcctgtcggcgggctgccgcatggccatcaccaggggcgagcccatgcaccccttgaagaccatggaagagggggggcgctgcacctggttcctgcccaattccgagccccgtacggcgcgcaagcagtggattttcggctccatgaagcccaccggcacattggtgctggacacaggcgcggcccgcgcgctggcccagggccgctcgctgctgcccgccggaatcaccgaaatcgctggaagcttcgagcgcggcgattgcgtgctggtcaaggacgcggacggcaaggtgctgggccgtggcctggtggcctattccgccgaggacgcccgcgccatcatgggccgcaaatcgggcgagatcgaagccatcttaggctttcgcggccgcgacgaactgatccaccgcgacgatctggtgatggagggatga

SEQ ID NO: 427 - protein, 370 aa, Magnetospirillum magnetotacticum MS-1
MNQLAAAKRLIVKIGSSLLVDESTGQVRRGWLETVAADIAACKARGQEVIVVSSGAVAVGRRKLGLTPPLKLEEKQAAAATGQIRLAHAWQDALAHHSITVAQVLLTLDDSENRRRYLNARSTLETLLRLGAVPVINENDTVATAEIRVGDNDRLAARVAQMVSADALVLFSDIDGLYTNDPRKDPTARFIPEVHELTPEIEAMAGDPGSAYGSGGMVTKLVAARICLSAGCRMAITRGEPMHPLKTMEEGGRCTWFLPNSEPRTARKQWIFGSMKPTGTLVLDTGAARALAQGRSLLPAGITEIAGSFERGDCVLVKDADGKVLGRGLVAYSAEDARAIMGRKSGEIEAILGFRGRDELIHRDDLVMEG

SEQ ID NO: 428 - DNA, 1104 bp, Nostoc punctiforme PCC 73102
  CDS (1)..(1104): transl_table=11
atgactaaaacaattgttgtcaaaatcggtacttctagcctaactcaagcagaaacgggacaattagcactttccactatcgctaccttggcggaaacactttgccatttgagaagccagggacaccgggtaattttggtttcttctggcgctgtgggtgtgggttgtgcaaggttggggttaactgaacgtcctagagcgatcgcactcaaacaagctgtagcagcagtcggacaaggtaggttaatccgtatatatgatgatttgtttactacgctgcaacaggcgatcgctcaagtattactgacacgaagcgatctagtacagcgcagccgctatctcaatgcctacaacacctttcaggaattactgggactgggagtgatccccatagtcaatgaaaatgataccgtagcaatagacgaactaaaatttggtgataatgataccctttcggcattagttgctagcttaatagaagcagattggctatttttgctcaccgatgtcgataggttgtactcagccgatccacgttctgtcccagatgctcgaccgatcgctctagttagtagcattaaagaattagctgaattacaaataggttcccaaggttctcagtggggtactggtgggatggtgacaaaaatttcggctgcgaggattgcgatcgcggcgggagttcgtaccgtaattacccaagggcgatttccccagaatatagaaaaaattatccaaggtgaactgattgggacgcattttgaaccgcaacctgaaccaacttcggcgcgtaaacgttggatagcttacggacttttacctgcgggtaaattgtatttagatgaaggtgcgatcgcggcaatttctctagcaggaaaatcgttattagctgctggaattaagttagtagaaggagagtttgacacacaggatgcagtgcaattgtgtgacagtaatggtaacgaaattgccagaggacttgtgaattacaacagcaatgatctgcaaaagattcgtggttgtcattcacgagaaatttccacaattttaggttatgccggtgcagaaacagttattcaccgagataatttggttttgatttag

SEQ ID NO: 429 - protein, 367 aa, Nostoc punctiforme PCC 73102
MTKTIVVKIGTSSLTQAETGQLALSTIATLAETLCHLRSQGHRVILVSSGAVGVGCARLGLTERPRAIALKQAVAAVGQGRLIRIYDDLFTTLQQAIAQVLLTRSDLVQRSRYLNAYNTFQELLGLGVIPIVNENDTVAIDELKFGDNDTLSALVASLIEADWLFLLTDVDRLYSADPRSVPDARPIALVSSIKELAELQIGSQGSQWGTGGMVTKISAARIAIAAGVRTVITQGRFPQNIEKIIQGELIGTHFEPQPEPTSARKRWIAYGLLPAGKLYLDEGAIAAISLAGKSLLAAGIKLVEGEFDTQDAVQLCDSNGNEIARGLVNYNSNDLQKIRGCHSREISTILGYAGAETVIHRDNLVLI

SEQ ID NO: 430 - DNA, 1152 bp, Haemophilus somnus 2336
  CDS (1)..(1152): transl_table=11
atggtaacttatggggaaatttttcaagtaaagacaactatggaaacacaaaaaacaaataaaaccattgtggtaaaatttggtaccagcaccttaacgcaaggttcatcaaaattaaatcgccctcacatgatggaaattgtgcgtcaaatcacacagttgcatcgagcaggctttcgtataattattgttacctccggagcgatggcagcggggcgacattatctcaatcatccgcaacttcctccaacaattgcctcaaagcaattactagcagcagtaggacaaagtcaactcattcaaacgtgggaacaacttttcgctatttatgatattcatattgggcaaattctgttaactcgagcggacattgaagatcgtgaacgttttatgaacgcaagagatacgttacatgctttattagataaccgaattattccggtaattaatgaaaatgatgcggttgcaaccgctgaaattaaagtgggggataatgacaacctttctgcattagtggctattttggcacaagcagaacaactctacttgctaacagatcaacgtggattatttgatagtgatccaagaaaaaatcctcaagcaaaactgatttccatagtcgataaaattactgatcatatccgctctattgccggaggaagtgggacaacgttagggacgggaggaatgacaacaaaaattagtgctgctgacatagcgactcgttccggtgttgaaaccattattgcaccgggtaatcttgaaaatgtcattgtcaatttggcttatggaaaagacatcggcacaaaatttgttgtgcagacagatcgcttggaaagccgtaaacagtggatctttgctgcaccggttgcaggtatagtaactattgatgagggagcggaaagtgcggtattgattcagcataaatctctattacctgcaggtattatcagtgttgaaggatgtttttctcgtggtgaagttgttaaaatttgtggttcgaacggtaaaaaaattgctttgggcgtacctcgctataacagcgattctctcatacaaataaaaggaaaaaaatcgcaagatattgaacagatcctcggttatgaatatggttctggtgctattcatcgtgatgatatggtcgtttattaa

SEQ ID NO: 431 - protein, 383 aa, Haemophilus somnus 2336
MVTYGEIFQVKTTMETQKTNKTIVVKFGTSTLTQGSSKLNRPHMMEIVRQITQLHRAGFRIIIVTSGAMAAGRHYLNHPQLPPTIASKQLLAAVGQSQLIQTWEQLFAIYDIHIGQILLTRADIEDRERFMNARDTLHALLDNRIIPVINENDAVATAEIKVGDNDNLSALVAILAQAEQLYLLTDQRGLFDSDPRKNPQAKLISIVDKITDHIRSIAGGSGTTLGTGGMTTKISAADIATRSGVETIIAPGNLENVIVNLAYGKDIGTKFVVQTDRLESRKQWIFAAPVAGIVTIDEGAESAVLIQHKSLLPAGIISVEGCFSRGEVVKICGSNGKKIALGVPRYNSDSLIQIKGKKSQDIEQILGYEYGSGAIHRDDMVVY

SEQ ID NO: 432 - DNA, 1092 bp, Actinobacillus pleuropneumoniae serovar 1 str. 4074
  CDS (1)..(1092): transl_table=11
atgcaaaagacaattgtgattaaattcggcaccagtactcttacgcacggaggaaagagtttaagccgtccttatatgctggaattagttaaacaaatagctcaacttcatcaacatcatcgagtgattgtcgtcacctccggagccgcagcagccggcagagattatttaggtcatcccgaacttcccaaaacactcgcctataaacaaatgcttgccgcagtcgggcaaagtcagctaatccgtacttgggaaaatttattcgatatttacggcattcatatcgggcaaattttattaacccgtgccgatattgatgatcgcgaacgttttttaaatgcgcgcgataccttaaatgccttgttggagcaaagaatcattcctgtgatcaatgaaaacgatacggttgccaccgaagaatttaaagtcggcgataatgacaatctttccgcattggttgcgattctagcgcatgccgatcaactttatcttttaaccgaccaagaaggcttatttgattccgatccgcgttcaaatccgcaagcgaaattactgtccgtcgtggaaaaaatcacgcctgaaatccgccaaatggcgggcggtagcgtcaccggactcggcaccggcggtatgagtactaaaattaccgccgccgatattgctacgcgttccggtgtcgaaaccgttatcgcttcaggctctcgtgcaaacgtattggtcgatttagctaacggcgaatccatcggtagtaagtttttagtacaatccgaccgcttggaaggtcgtaaacaatggttattcgccgctccgcaagtcggctcgcttgtggtggataaaggggcggaagctgcattattacaacataaatcattactgccggtcggtgtttccgagattaacggcgtctttagccgaggcgaagtagtgaaaatttttaaccaagaaggtaaagcgcttgctttggggcttgctcgttataacagcgatgcgttaattcgtattaaaggaaaaaaatcgaaagagattgagtctctgctcggttatgaattcggttccgtcgccgtacatattgatgagatggtcatttattaa

SEQ ID NO: 433 - protein, 363 aa, Actinobacillus pleuropneumoniae serovar 1 str. 4074
MQKTIVIKFGTSTLTHGGKSLSRPYMLELVKQIAQLHQHHRVIVVTSGAAAAGRDYLGHPELPKTLAYKQMLAAVGQSQLIRTWENLFDIYGIHIGQILLTRADIDDRERFLNARDTLNALLEQRIIPVINENDTVATEEFKVGDNDNLSALVAILAHADQLYLLTDQEGLFDSDPRSNPQAKLLSVVEKITPEIRQMAGGSVTGLGTGGMSTKITAADIATRSGVETVIASGSRANVLVDLANGESIGSKFLVQSDRLEGRKQWLFAAPQVGSLVVDKGAEAALLQHKSLLPVGVSEINGVFSRGEVVKIFNQEGKALALGLARYNSDALIRIKGKKSKEIESLLGYEFGSVAVHIDEMVIY

SEQ ID NO: 434 - DNA, 1107 bp, Haemophilus influenzae R2846
  CDS (1)..(1107): transl_table=11
atgaacaaaaaaacaatcgttgtgaaattcggtacaagcacgctaactcagggttcgccaaaactgaattcgccacatatgatggaaatcgttcgtcaaattgcacaattgcataatgatggatttcgtatagtgatcgtgacttctggtgcgattgcagcgggtcgtcattatttaaatcatcctcaattaccacctactatcgcctcaaagcaactgcttgcagcggttggtcaaagccaattaattcaggcttgggaaaaattatttgctatttatgatatccatatcgggcaacttttattaacccgtgcagatattgaagatcgcgaacgttttttaaatgcgcgagatactttacacgcacttttagataaccacattattcctgtgattaatgaaaatgacgcggtggcgactgcggaaattaaagtaggtgacaatgacaatttatcggcattagtcgctattcttgtgcaagcggaacagctttatttattgactgatcaacaaggtttatttgatagtgatccgcgtaaaaattctgaagcgaaattaattccaattgtagaacaaattaccgatcatattcgatcaattgcaggaggaagtggtacaaatcttggtactggtggaatgatgaccaaaatcattgctgccgatgttgcgactcgctctggaattgaaaccattattgctccaggtaatcgcccaaatgtaattgcagatcttgcttatgaaaaaaatattggtacaaaatttattgcacaccaatctgatcgattagaaagccgcaaacaatggcttttcgccgcaccatcggcaggtattattaccattgataacggtgcgcaaaatgccattcttgaacaaaataaatctttattacccgctggtattattaacgtggaagggcgtttttcgcgtggtgaagtagtcaaaatacgcactcaatcaggtaaagacattgcgctgggtatgccacgctataacagcgatgctctacaattaattaagggcagaaaatcagcagacattgagaatgttttaggctatgaatatggtgcggtggcaatgcatcgtgatgatatgattattttgtcataa

SEQ ID NO: 435 - protein, 368 aa, Haemophilus influenzae R2846
MNKKTIVVKFGTSTLTQGSPKLNSPHMMEIVRQIAQLHNDGFRIVIVTSGAIAAGRHYLNHPQLPPTIASKQLLAAVGQSQLIQAWEKLFAIYDIHIGQLLLTRADIEDRERFLNARDTLHALLDNHIIPVINENDAVATAEIKVGDNDNLSALVAILVQAEQLYLLTDQQGLFDSDPRKNSEAKLIPIVEQITDHIRSIAGGSGTNLGTGGMMTKIIAADVATRSGIETIIAPGNRPNVIADLAYEKNIGTKFIAHQSDRLESRKQWLFAAPSAGIITIDNGAQNAILEQNKSLLPAGIINVEGRFSRGEVVKIRTQSGKDIALGMPRYNSDALQLIKGRKSADIENVLGYEYGAVAMHRDDMIILS

SEQ ID NO: 436 - DNA, 1107 bp, Haemophilus influenzae R2866
  CDS (1)..(1107): transl_table=11
atgaacaaaaaaacaatcgttgtgaaattcggtacaagcacgctaactcagggttcgccaaaactgaattcgccacatatgatggaaatcgttcgtcaaattgcacaactgcataatgatggatttcgtatagtgatcgtgacttctggtgcgattgcagcgggtcgccattatttaaatcatcctcaattaccacccactatcgcctcaaagcaactgcttgcagcggttggtcaaagccaattaattcaggcttgggaaaaattatttgctatttatgatatccatatcgggcaacttttattaacccgtgcagatattgaagatcgcgaacgttttttaaatgcgcgagatactttacacgcacttttagataaccacattattcctgtgattaatgaaaatgacgcggtggcgactgcggaaattaaagtaggtgacaatgacaatttatcggcattagtcgctattcttgtgcaagcggaacagctttatttattgactgatcaacaaggtttatttgatagtgatccgcgtaaaaattctgaagcgaaattaattccaattgtagaacaaattaccgatcatattcgatcaattgcaggaggaagtggtacaaatcttggtacaggtggaatgatgaccaaaatcattgctgccgatgttgcgactcgctctggaattgaaaccattattgctccaggtaatcgcccaaatgtaattgcagatcttgcttatgaacaaaatattggtacaaaatttattgcacaccaatctgatcgattagaaagccgcaaacaatggcttttcgccgcaccatcggcaggtattattaccattgataacggtgcgcaaaatgccattcttgaacaaaataaatctttattacctgctggtattattaacgtggaagggcgtttttcgcgtggtgaagtagtcaaaatacgcactcaatcaggtaaagacattgcgctgggtatgccacgctataacagcgattccctacaattaattaagggcagaaaatcagcagacattgagaatgttttaggctatgaatatggcgcggtggcaatgcatcgtgatgatatgattattttgtcataa

SEQ ID NO: 437 - protein, 368 aa, Haemophilus influenzae R2866
MNKKTIVVKFGTSTLTQGSPKLNSPHMMEIVRQIAQLHNDGFRIVIVTSGAIAAGRHYLNHPQLPPTIASKQLLAAVGQSQLIQAWEKLFAIYDIHIGQLLLTRADIEDRERFLNARDTLHALLDNHIIPVINENDAVATAEIKVGDNDNLSALVAILVQAEQLYLLTDQQGLFDSDPRKNSEAKLIPIVEQITDHIRSIAGGSGTNLGTGGMMTKIIAADVATRSGIETIIAPGNRPNVIADLAYEQNIGTKFIAHQSDRLESRKQWLFAAPSAGIITIDNGAQNAILEQNKSLLPAGIINVEGRFSRGEVVKIRTQSGKDIALGMPRYNSDSLQLIKGRKSADIENVLGYEYGAVAMHRDDMIILS

SEQ ID NO: 438 - DNA, 1119 bp, Rubrivivax gelatinosus PM1
  CDS (1)..(1119): transl_table=11
atgtccgaagtgctgcgtggagcgaggcgcatcgtcgtcaaggtcggatccagcctcgtgaccaacgaggggcgcggtgtcgatgccgccgcgatcggcaactggtgccgccagctcgcgtcgctggcgggtcaggggcgcgaggtgctgatggtgtccagcggcgcgatcgccgaaggcatgaagcgcttgggctggaacgcgcgaccgaaggagattcatgagttgcaggccgctgccgccgtcggacagatggggctggcgcagatgtacgagagcaagctttcggagcatggcatcggcagcgcgcaggtgctgttgacgcacgccgacctcgcggaccgcgagcgctacctgaacgcacgctcgaccctgctcaccctgttgtcactgaaggtgatcccggtcatcaacgagaacgacacggtcgtcaacgacgagatcaagttcggcgacaacgacacgctgggcgcactggtcgccaacctcgtcgacgctgatgcgctggtgatcctgaccgatcagcctggcctgtattccgccgatccgcgcaaggacccgcaggcccggttcatcggtgaggctgtcgccggaacgccggaactcgagcggatggcaggtggtgcgggctccagcctcgggcgtggcggcatgatcaccaaggtgctggccgccaagcgtgcctccagcagcggggcctcgaccgttatcgcctggggtcgtgaacccgacgtgctgctgcgactcgctgacggtgaggcgatcggcacgctgctggtcgctcgcactgccaagctcgcggcgcgcaagcagtggatggccgaccatctgcagatgcgcggcacggtcgtcatcgacgacggcgccgtcgccaagctgcgcgacgaaggcaagagtctgctgccgatcggcgtggtcgaggtgcagggcgagttcgtgcgaggtgacgtgatcgcggtgcggagccaggtcggtatcgaaatcgcgcggggcctggccaactacgcgagcagcgaggcgcggctgatcgcgcgcaagccgtcgtcgcagatcgagagtctgctgggctacagcaacgagcccgagatgatccaccgcacgaatctcgtgctggcctga

SEQ ID NO: 439 - protein, 372 aa, Rubrivivax gelatinosus PM1
MSEVLRGARRIVVKVGSSLVTNEGRGVDAAAIGNWCRQLASLAGQGREVLMVSSGAIAEGMKRLGWNARPKEIHELQAAAAVGQMGLAQMYESKLSEHGIGSAQVLLTHADLADRERYLNARSTLLTLLSLKVIPVINENDTVVNDEIKFGDNDTLGALVANLVDADALVILTDQPGLYSADPRKDPQARFIGEAVAGTPELERMAGGAGSSLGRGGMITKVLAAKRASSSGASTVIAWGREPDVLLRLADGEAIGTLLVARTAKLAARKQWMADHLQMRGTVVIDDGAVAKLRDEGKSLLPIGVVEVQGEFVRGDVIAVRSQVGIEIARGLANYASSEARLIARKPSSQIESLLGYSNEPEMIHRTNLVLA

SEQ ID NO: 440 - DNA, 1119 bp, Burkholderia vietnamiensis G4
  CDS (1)..(1119): transl_table=11
atgcgttcgatcatcgcggattcgaagcgattggtggtgaaggtgggttcaagcctcgtgaccaacgacggcaagggcctcgatcatgcggcaatcggccgctgggcggcgcagatcgctgcgctgcgcgcgcagggcaaggaagtggtgctggtcagctcgggcgcgatcgccgaggggatgcagcgtctcggctggaacaagcgtccgcgcgaaatcgacgaattgcaggccgccgcggcggtcgggcagatggggctcgcgcaagtctacgaaagccgcttcaccgagcatcacattcgcaccgcgcagatcctgctcacgcatgccgacctggccgatcgcgagcgctatctgaacgcgcgctcgacgttgctcacgctgctgcgcctcggcgtcgtgccgatcatcaacgagaacgacacggtggtcaccgacgaaatcaagttcggcgacaacgacacgctcggcgcgctcgtcgcgaacctgatcgaaggcgatgcactgatcatcctgaccgaccagacggggttgttcaccgccgatccgcgcaaggatccgaacgcaacgctcgtcgcggaagcgagcgcaggcgcgccggagctcgagtcgatggcgggcggcgcggggtcgagcctcggccgcggcgggatgctgacgaagatcctcgcagcgaagcgcgccgcgcacagtggcgcgaacaccgtgatcgcgagcggccgcgaggccgacgtgctggtgcggctggccgcgggtgaggcgatcggcacgcagctgatcgcacggaccgcgcggatggccgcgcgcaagcaatggatggccgatcatctgcaggtgcgcgggcacgtcgtgatcgatgcgggcgcagtcgagaagctgagggacggcggcaagagcctgctgccgatcggcgtgatcgacgtgcagggcgcgtttgcacgcggcgaggtgatcgcgtgcgtcggcccggacgggcgtgaagtggcgcgcggcctcacgaactacagcagcgcggaaacgaagctgattcaccgcaagccgagcggcgagatcgagacggtgctcggctacatgctcgaacccgagctgattcaccgcgacaacctcgtgctggtctga

SEQ ID NO: 441 - protein, 372 aa, Burkholderia vietnamiensis G4
MRSIIADSKRLVVKVGSSLVTNDGKGLDHAAIGRWAAQIAALRAQGKEVVLVSSGAIAEGMQRLGWNKRPREIDELQAAAAVGQMGLAQVYESRFTEHHIRTAQILLTHADLADRERYLNARSTLLTLLRLGVVPIINENDTVVTDEIKFGDNDTLGALVANLIEGDALIILTDQTGLFTADPRKDPNATLVAEASAGAPELESMAGGAGSSLGRGGMLTKILAAKRAAHSGANTVIASGREADVLVRLAAGEAIGTQLIARTARMAARKQWMADHLQVRGHVVIDAGAVEKLRDGGKSLLPIGVIDVQGAFARGEVIACVGPDGREVARGLTNYSSAETKLIHRKPSGEIETVLGYMLEPELIHRDNLVLV

SEQ ID NO: 442 - DNA, 1113 bp, Crocosphaera watsonii WH 8501
  CDS (1)..(1113): transl_table=11
atgaacccctcccaaacgattgttgtcaaagttggtacctctagtcttgctcaaccagagacaggaaaattagctttatctactatagctgctttggtggaaactttaaccgaattacgacaattcggctatcatgttgtcttagtttcctctggtgctgtgggagtgggttgtagtcgtttaaaattaacagaaaaacccaaaaaaatagtcataaaacaagctattgctgccgtgggacaaggtagattaattagagtttatgatgacctttttacagctttaaatcaacccattgcccaagttttattaacccgtcgagaattaatggaacggagttgttatgttaatgctaaaaatacctttgatgctctgtttgaattaggggttattcctattgttaatgaaaatgatactgttgctattgaagagttgaaatttggagataatgataccctttctgctttagttgctagtttaattaatgctgattggttgtttattttaaccgatgttgatcgactttattctgctgatcctcgcacctttccagatgctaaacctatcaaagttgttaatagtttagaattagataaattagaaattaaagcaggaggaaaaggatctcaatggggtacaggagggatgtcaaccaagctaacagcagcaagactggcaacatccgcaggtattactacagttataacccacggaaaaaagccaggaaacttattaaaaattattaaaggtgaagatattggcactaaatttgaggcacaattaaataatgataatgcccgcaaacgttggatctattatggattattacccagaggaaaattatatcttgatcggggggcagttaaagccatttctcaaaaaggaaaatctctgttaccagcaggaataattaaagttgaaggtgagtttgattctttagaggcagtgcaattatacaatgaaagtggtcaagaaattgggagaggaattgttaattataatcaggaagaaattgataaaataaaaggcaatcactcggataaaatacctgaattattaggttgtcatggagcagaaaccattgtccatcgagataatttagttattaattga

SEQ ID NO: 443 - protein, 370 aa, Crocosphaera watsonii WH 8501
MNPSQTIVVKVGTSSLAQPETGKLALSTIAALVETLTELRQFGYHVVLVSSGAVGVGCSRLKLTEKPKKIVIKQAIAAVGQGRLIRVYDDLFTALNQPIAQVLLTRRELMERSCYVNAKNTFDALFELGVIPIVNENDTVAIEELKFGDNDTLSALVASLINADWLFILTDVDRLYSADPRTFPDAKPIKVVNSLELDKLEIKAGGKGSQWGTGGMSTKLTAARLATSAGITTVITHGKKPGNLLKIIKGEDIGTKFEAQLNNDNARKRWIYYGLLPRGKLYLDRGAVKAISQKGKSLLPAGIIKVEGEFDSLEAVQLYNESGQEIGRGIVNYNQEEIDKIKGNHSDKIPELLGCHGAETIVHRDNLVIN

SEQ ID NO: 444 - DNA, 1155 bp, Xylella fastidiosa Dixon
  CDS (1)..(1155): transl_table=11
atgaccggcatccctcccccctcccgcttccccgaacaacccatccccccgtggcgccgcgccgtcctcaaagtgggcagcagcctcctcgccgccgatggcggcggcctttccccccgctttgccttggacttagcacacttcgtctccgccaacatcaccgccggacgccaactcgtcatcgtctcctctggcgctgtcgccgctggtcgtgccctgatacccccactgcccgaatccggcggcgctctcgccgcacgccaagccttagccgcccttggacaagcacaactcatcgcactgtggcaacgcttcttcgaccgccccgttgcccaggtcctcctgacccacgacgacctccgcaaccgccgtcgctacctcaacgcacgtgccacattgcgtgaactactgcacctgggcaccttgcccgtcgtcaacgaaaacgacaccgtctccgtagatgaactcaaactgggcgacaacgacaatctggcagccattgttgccgcactgattgatgcccaagccctgtttatcgccaccgatattgacggcttatacaccaccgacccacgccaccatcccgacgcacagcccctgcatgaagtccgcaccctgacccctgaacacctcgccatggctggtgacagcagcagcaccggcggcaccggcggcatgcgtaccaaacttgaagcagcacttaaagccggcgccgctggcattgacacctacctatttaacggccgcagcagcgacgttgtccgcggactcgcacaacaccgcctccgcggcacccgcatccatcccacctgtaccccgattgctgcccgtaaatattggttgcgtcacgccccagtcgagcccggcgcgattctcattgatgccggtgccgccgctgccttggcacaacaaggcgcttccctacttccgggcggcgttttgagtgccgaaggcgacttccgccgcggcgatatgatccagatagccacccgcagcccagatcacccctcccaccccctggcacgcggacttgtccaatactcagccgccgatgtccgccgcattgccggttgccattcccgcgatattcaaaccctccttggatacacctatggcgacacaatcgttcaccgtgatgacctcgtcctcctctga

SEQ ID NO: 445 - protein, 384 aa, Xylella fastidiosa Dixon
MTGIPPPSRFPEQPIPPWRRAVLKVGSSLLAADGGGLSPRFALDLAHFVSANITAGRQLVIVSSGAVAAGRALIPPLPESGGALAARQALAALGQAQLIALWQRFFDRPVAQVLLTHDDLRNRRRYLNARATLRELLHLGTLPVVNENDTVSVDELKLGDNDNLAAIVAALIDAQALFIATDIDGLYTTDPRHHPDAQPLHEVRTLTPEHLAMAGDSSSTGGTGGMRTKLEAALKAGAAGIDTYLFNGRSSDVVRGLAQHRLRGTRIHPTCTPIAARKYWLRHAPVEPGAILIDAGAAAALAQQGASLLPGGVLSAEGDFRRGDMIQIATRSPDHPSHPLARGLVQYSAADVRRIAGCHSRDIQTLLGYTYGDTIVHRDDLVLL

SEQ ID NO: 446 - DNA, 1155 bp, Xylella fastidiosa Ann-1
  CDS (1)..(1155): transl_table=11
atgaccggcatccctcccccctcccgcttccccgaacaacccatccccccgtggcgccacgccgtcctcaaagtgggcagcagcctcctcgccgccgatggcggcggcctctccccccgctttgccttggacttagcacacttcgtctccgccaacatcaccgccggacgccaactcgtcatcgtctcctctggcgctgtcgccgctggtcgtgctctgatacccccactgcccgaatccggcggcgctcttgccgcacgccaagccttagccgcccttggacaagcacaactcatcgcactgtggcaacgcttcttcgaccgccccgttgcccaggtcctcctgacccacgacgacctccgcaaccgccgtcgctacctcaacgcacgtgccacattgcgtgaactactgcacctgggcaccttgcctgtcgtcaacgaaaacgacaccgtctccgtcgatgaactcaaactgggcgacaacgacaacctggcagccattgttgccgcactgattgatgcccaagccctgtttatcgccaccgatattgacggcttatacaccaccgacccacgccaccatcccgacgcacagcccctgcatgaagtccgcaccctgacccctgaacacctcgccatggctggtgacagcagcagcaccgttggcacaggcggtatgcgtaccaaacttgaagcagcacttaaagccggcgccgctggcattgacacctacctatttaacggccgcagcagcgacgttgtccgcggactcgcacaacaccgcctccgcggcacccgcatccatcccacctgtaccccgattgccgcccgtaaatattggttgcgtcacgccccagtggagcccggcgcgatcctcatcgatgccggtgccgccgctgccttggcacaacaaggcgcttccctacttccgggcggcgttttgagtgccgaaggcgacttccgccgcggcgatatgatccagatagccacccgcagcccagatcacccctcccaccccctggcacgcggacttgtccaatactcagctgccgatgtccgccgcattgccggttgccattcccgcgatattcaaaccctccttggatacacctatggcgacacaatcgttcaccgtgatgacctcgtcctcctctga

SEQ ID NO: 447 - protein, 384 aa, Xylella fastidiosa Ann-1
MTGIPPPSRFPEQPIPPWRHAVLKVGSSLLAADGGGLSPRFALDLAHFVSANITAGRQLVIVSSGAVAAGRALIPPLPESGGALAARQALAALGQAQLIALWQRFFDRPVAQVLLTHDDLRNRRRYLNARATLRELLHLGTLPVVNENDTVSVDELKLGDNDNLAAIVAALIDAQALFIATDIDGLYTTDPRHHPDAQPLHEVRTLTPEHLAMAGDSSSTVGTGGMRTKLEAALKAGAAGIDTYLFNGRSSDVVRGLAQHRLRGTRIHPTCTPIAARKYWLRHAPVEPGAILIDAGAAAALAQQGASLLPGGVLSAEGDFRRGDMIQIATRSPDHPSHPLARGLVQYSAADVRRIAGCHSRDIQTLLGYTYGDTIVHRDDLVLL

SEQ ID NO: 448 - DNA, 1077 bp, Streptococcus suis 89/1591
  CDS (1)..(1077): transl_table=11
atgacagaaaaaacaattgtatttaaggtcgggacaagttctctgacccaagaaaatggcagtctggaccgtatcaagattgctcggattaccaatcagctggctcagttgcatcagaagggctaccagattgtgctggtgacgtcgggctcgattgctgctggttttcggagattgggctttgagaaacgaccaaccaagattgcggagaagcaggcttctgcggccgttggacaaggtttgctgattgaggaatatacgcaaaatctgatgaaagatggcattgtgtcggctcagattttgctgacccaggatgattttgcggatgccagacgttatcagaatgcctctcaagccttacaggtcttgctgaaacaacgtgttattcctattatcaacgaaaatgataccattgccattgaggagattaaggtaggggacaatgatactttatctgcccaggtggcttctctcttgaaagcagacctcttggtactcttgacggatgtggatgggctttacacggccaatcccaacagcgatcccaatgccaaacatttgccagtgattacggaaattacggaagatttatttgccatggcagcaggagctggctcgtccaacggaacaggtggcatgaccaccaaattgcaggcggcccagattgcgaccaagtcaggcgtgcccgtctttatctgctcttcaaaagaggataccgccctcttacaggcggtcacccaagccaatcgtggaacgctctttttagctgacgaccacgccatgaaccaacgcaagcagtggatggccttctatgctcggacagacgcagcagttgaagtggatgcaggagcggttgatgccatgttgcaccagggccgcagtttgttagctactggtgtcaaagccctggaaggcgactttgaagtgggccaggtcgtagaggtttatagccaagcagaccatcgtttgattggtaaaggacgggtcaaactgtcctccaaggacttgcaggaccagttggcaaatggcagagcggaaggtgtgtttattcaccgcaacgattgggtgagcttatag

SEQ ID NO: 449 - protein, 358 aa, Streptococcus suis 89/1591
MTEKTIVFKVGTSSLTQENGSLDRIKIARITNQLAQLHQKGYQIVLVTSGSIAAGFRRLGFEKRPTKIAEKQASAAVGQGLLIEEYTQNLMKDGIVSAQILLTQDDFADARRYQNASQALQVLLKQRVIPIINENDTIAIEEIKVGDNDTLSAQVASLLKADLLVLLTDVDGLYTANPNSDPNAKHLPVITEITEDLFAMAAGAGSSNGTGGMTTKLQAAQIATKSGVPVFICSSKEDTALLQAVTQANRGTLFLADDHAMNQRKQWMAFYARTDAAVEVDAGAVDAMLHQGRSLLATGVKALEGDFEVGQVVEVYSQADHRLIGKGRVKLSSKDLQDQLANGRAEGVFIHRNDWVSL

SEQ ID NO: 450 - DNA, 1110 bp, Sulfitobacter sp. EE-36
  CDS (1)..(1110): transl_table=11
ttggcaaccctaagcgacggcacccgtatcgttgtaaaaatcggctcggcgctgctcgtcgatcgggccaccggccagcttcgccgcgattggctgcaaagtctcgcgcaggatgtggcgtggctcaaggggcagggcaaggatgtggtgctggtgtcttcgggctccatcgcattggggcgtggtgtgcttgggctgccggcaaccacgcttgcgctggaacaatcccaagccgcggcggcggtggggcaaatccgtctcgcccgcgcctatgaagaggcgctggaaccctacgggatcaccgccgcgcaggtgcttgtcaccctggaagacagcgcggatcgtcggcggtatctcaacagccgcgccacgatggagcagctgttgtccatgggggcggtacccatcgtcaacgagaatgacaccgtcgccacggacgagattcgctttggcgacaatgaccggctcgcggcgcagatcgccgtgaccgtggcagccgaccggttgatcctgctgtcggatgtggatggtttctattccgccaatcccaatgacgaccccgatgccatccgctatgaggtgatcgacacgattaccccagaaatcgaggcgcaggcgggcgatgcgggctctggcctgtccaagggcggcatgaagacaaagctgatggccgcgaaaaccgcgactgctgcgggctgcgctatggccatctccgaaggatcaccgttgcggcctttgctgaccctcgaaaacggggccaacgccacttggttcaccgcgcaatccgacccccaaaccgcgcgcaaacaatggattacggcactcaaaccgcgcggcagcgtcacattggatgccggtgcagtggctgccatgtccaagggcaagtcgcttttgcccgccggtgtcaccgctgtttccggccctttcgggcgcggcgactccgtcgcgctgctggccccagatgggcgccccatcgggcacgggctgacacgctatacctcggcagaggcagagctgatcaaaggtcgtcaatcctcggagatcgaggccattctgggcgcgccgggacgtgctgctttgatccatcgggacgatcttgcgctttcctga

SEQ ID NO: 451 - protein, 369 aa, Sulfitobacter sp. EE-36
MATLSDGTRIVVKIGSALLVDRATGQLRRDWLQSLAQDVAWLKGQGKDVVLVSSGSIALGRGVLGLPATTLALEQSQAAAAVGQIRLARAYEEALEPYGITAAQVLVTLEDSADRRRYLNSRATMEQLLSMGAVPIVNENDTVATDEIRFGDNDRLAAQIAVTVAADRLILLSDVDGFYSANPNDDPDAIRYEVIDTITPEIEAQAGDAGSGLSKGGMKTKLMAAKTATAAGCAMAISEGSPLRPLLTLENGANATWFTAQSDPQTARKQWITALKPRGSVTLDAGAVAAMSKGKSLLPAGVTAVSGPFGRGDSVALLAPDGRPIGHGLTRYTSAEAELIKGRQSSEIEAILGAPGRAALIHRDDLALS

SEQ ID NO: 452 - DNA, 1107 bp, Roseovarius nubinhibens ISM
  CDS (1)..(1107): transl_table=11
atggcaaccgtaagcacggcacggcggatcgtcatcaagatcggatcggcgctgttggtggaccgggtgagcggcgcgttgcgcgatgcctggctcgggtcgttgatcgaggatgtggcctggctgcgtagcaagggcgcggaggtggttcttgtgtcgtcggggtcgattgcgctgggccgggccgagcttgggcttggcaatgcggagctgtcgctcgaacagagccaggcggcggcggcggtggggcagatccggcttgccggggcctatgaggccgcgctcaaatcccacgggatcaaggcggcgcaggtgttgctcacgctggaggacagcgagaaccggcggcgctatctcaacacgcgggcgacgctcgatcagctgttgcgattgggtgtggtgcccatcgtcaacgagaatgacaccgtggccaccgatgagatccgctatggcgacaatgaccggatggcggcgcaggtcgcggtgacggcgggggcggatcagctcatcctcctgagcgatgtggatgggttctattcggccaacccgaatgacgaccccacggccaagcggttcgacgaaatcaccgccatcacgcccgagatcgaggcgatggcgggcgatgcgggatcggggctcagcaagggcgggatgaagaccaagctcatggcggcgcgcacggcgatggcggcgggctgtgacatggcgatttccgagggcagcgtgaccaacccggtgcaggccatcgagggcggtgcgccggtcacatggttccgaggccagggcgatccgcaagcgcggcgcaaggcctggatcggtggcatgaagccgcgcggccggatcatcgtggatgcaggcgctgtggcggcgctcgaggccgggagcagcctcttgccggcgggcgtcagcgcgatcgagggccggtttggccggggcgatccggtgcaggtgcgggcgcaggacgggcgggtgctcggccaggggctcacgcgctatgatgcggaggaggcggccaagatcctcgggttgcgcaccgatgcgattgccgaggctttgggatatgcggcgcggggggccttgatccaccgcgacgacatggcattttaa

SEQ ID NO: 453 - protein, 368 aa, Roseovarius nubinhibens ISM
MATVSTARRIVIKIGSALLVDRVSGALRDAWLGSLIEDVAWLRSKGAEVVLVSSGSIALGRAELGLGNAELSLEQSQAAAAVGQIRLAGAYEAALKSHGIKAAQVLLTLEDSENRRRYLNTRATLDQLLRLGVVPIVNENDTVATDEIRYGDNDRMAAQVAVTAGADQLILLSDVDGFYSANPNDDPTAKRFDEITAITPEIEAMAGDAGSGLSKGGMKTKLMAARTAMAAGCDMAISEGSVTNPVQAIEGGAPVTWFRGQGDPQARRKAWIGGMKPRGRIIVDAGAVAALEAGSSLLPAGVSAIEGRFGRGDPVQVRAQDGRVLGQGLTRYDAEEAAKILGLRTDAIAEALGYAARGALIHRDDMAF

SEQ ID NO: 454 - DNA, 1137 bp, Oceanicola batsensis HTCC2597
  CDS (1)..(1137): transl_table=11
ttggcagccctgaccgacaccggcctctccggcgcgcgccgggtggtcatcaagatcggctcggcgcttctggtcgagcgcgagacgggtctgctgcgcgccgactggcttggcgggctggccgaggacgtggcgatgctgcgcgcgcggggtgtcgacgtggtgctggtctcgtccggctccatcgcgctcgggcggggggtgctgggcctcgggctcggcgacctgtcgctggaacaggcgcaggccgcggcggcgaccggtcagatcggcctggcagctgcctattccggcgcgctcggccgccacgggatcaaggtcgggcaggtgctcgtgacgctcgaggacagcgctgaccggcggcgctacctgaactcgcgtgcgacgctgcagacactcctgacttacggtgttgtcccgatcgtcaacgagaacgacaccgtcgccacggacgagatccgctatggcgacaacgaccgtctcgccgcgcaggtcgcggtcaccgtcggcgcggaccggctggtgctgctgtcggatgtggacgggctctatacggccaatcccaacatcgacccgaccgcgcggcggctggaccgggtggtccagatcacgcccgagatcgaggcgatggccggggatgcggggtcgggcctgtccaagggcggcatgaagaccaaggtcatggccgccaagaccgccaccgccgcgggctgcgccatggcgatcacgcacggctttcgcatgaaccccgtgcgggcactcgaggagggggcaaacgccacctggttccaggccaagggcgacccgcagaccgcccggaagggatggatcggctcgatgaagcccagagggcggctggtgttggatgacggcgcggtacgcgcgatgcggcaggggcgatcgctcctgcccgccggtgtcgcccgggtcgaggggcggttcggccgtggcgatccggtcgaactgacgggcccgaacgaagaggttctggcgcagggcctgacccgctacactgccgacgaggcgcggcgcatcgccgggcaccgctcggacgagatcgaggcgctgctcggctatcccggccgggcggcattggtgcacagggatgatcttgccttcctggcattggttgagtga

SEQ ID NO: 455 - protein, 378 aa, Oceanicola batsensis HTCC2597
MAALTDTGLSGARRVVIKIGSALLVERETGLLRADWLGGLAEDVAMLRARGVDVVLVSSGSIALGRGVLGLGLGDLSLEQAQAAAATGQIGLAAAYSGALGRHGIKVGQVLVTLEDSADRRRYLNSRATLQTLLTYGVVPIVNENDTVATDEIRYGDNDRLAAQVAVTVGADRLVLLSDVDGLYTANPNIDPTARRLDRVVQITPEIEAMAGDAGSGLSKGGMKTKVMAAKTATAAGCAMAITHGFRMNPVRALEEGANATWFQAKGDPQTARKGWIGSMKPRGRLVLDDGAVRAMRQGRSLLPAGVARVEGRFGRGDPVELTGPNEEVLAQGLTRYTADEARRIAGHRSDEIEALLGYPGRAALVHRDDLAFLALVE

SEQ ID NO: 456 - DNA, 1134 bp, Erythrobacter sp. NAP1
  CDS (1)..(1134): transl_table=11
atgactatcgaagcactcctcgattttcgcgatgtgtccaaatgtccgacgctggtcataaagatcggctcggcgctcctcgtccatactgacgggacgccgcgtttcgactggctgcgcagcgtagcgcacgaaattgccggtgcgcgtgagcgggggcagaaagtgatcgtcgtggcatcgggctcggttgccttgggcgcagccatgcttgaattgcccggaggcggtcgcgatacgctcgcacatgcgcaggccgcagcctccgtcgggcaggtgtttctcgccagcacatgggcgcagatgtttgccgaacacaatctgatggccggccagatgctgctttcgcttgatgatcttgaaaatcgcggacgctatctcaacgcgcgagccactttgcgcgaactgcttgagcgcggtgcgatcccgatcatcaacgaaaacgacaccaccgcgacgcaagagatcaagttcggcgacaacgaccggctggcagcgcgcgtcgctcaggcggctggcgccaatggcgtgatcctgctgaccgatgtcgagggcctgtacaccgcgcatccaagcgagccgaatgcagaactgctcgaagaggttcgcggcgtcactccggaaatgcacgccatggccacaggcggctctgggtcgggcatggggtcgggcggcatgagctcgaaactgctcgccgctgaaatcgcggaacgtgcggggattgcgcttacgatcatcaagggcgtcgatgactaccccattggccgcgcgctgagcgctaacctgggaacagttttcctgcccaagcgcgatgacaacgcattcaagtcctggatcggtggaaggatgcgtttcaacggctcgctcaggatcgatgctggagcggtagaagcgctgcgcggaggcaagagcctgcttgctgcaggtgtgaccgacgtcttcggaaagttcgaacgcgcggacgtgatcgctatcgaagaccccgatggacgcatgattgccaagggtatggtcgaatacgattcgaaccaatgcgatgcgatcaagggtctgcgcagcgaacagctttccgaaaagctgggcacgatcccgcgctcagcggtgatccatcgcgatcagatggttctgttgtag

SEQ ID NO: 457 - protein, 377 aa, Erythrobacter sp. NAP1
MTIEALLDFRDVSKCPTLVIKIGSALLVHTDGTPRFDWLRSVAHEIAGARERGQKVIVVASGSVALGAAMLELPGGGRDTLAHAQAAASVGQVFLASTWAQMFAEHNLMAGQMLLSLDDLENRGRYLNARATLRELLERGAIPIINENDTTATQEIKFGDNDRLAARVAQAAGANGVILLTDVEGLYTAHPSEPNAELLEEVRGVTPEMHAMATGGSGSGMGSGGMSSKLLAAEIAERAGIALTIIKGVDDYPIGRALSANLGTVFLPKRDDNAFKSWIGGRMRFNGSLRIDAGAVEALRGGKSLLAAGVTDVFGKFERADVIAIEDPDGRMIAKGMVEYDSNQCDAIKGLRSEQLSEKLGTIPRSAVIHRDQMVLL

SEQ ID NO: 458 - DNA, 1110 bp, Synechococcus sp. RS9917
  CDS (1)..(1110): transl_table=11
atgacgctgcgggtggtgaaggtgggcaccagcctgctccgcggcgacgacggctcttccacctcagcggtgatcggctggctgacggatgcgctcgccgcgagcctgatccagggcgatcgcacggtgctcgtgagcagtggcgccgtaggcctgggctgccggcgcctggggttgagtcaccgccccgacaacgtggtcgccctgcaggcggccgcagccgtgggccaggggcacctgatgagtctctatgaagaagcgatggctcgccatggccagcccgtggcgcaggtgctgctcacccgctccgatctcgccgaccgccgcagctaccgcaccgcttcagccaccctgcaccagcttctcgactggggggtgctgccggtggtcaacgagaacgacaccgtgtcgtcagcggaattgcgcttcggcgacaacgacaccctctcagccctggtggcggcagcggtggaagccgatgagctgatcctgctcacggatgtggatcgtctctacaccgccgatccccgcaccgatgccaatgcccatccgatcacggatgtgcaccatcccgccgaactggcccgcctgcaggatggggccggcgatggcggccgctggggaaccggaggcatgaccaccaaactggcagcagcacggatcgccacggccagcggcatcaccgtgcacctggccgatggccggcagcccgaggtgctcaagaagctgctcagcggtggccggggtggcactgtgtttcatccccaccccgaaccgctgggcaaccgcaaaagctggcttgcccatgcccttcggccccagggggatctcaggctcgacaacggagcctgcaacgccctggaacaacgcggtgcctccctgctgctggtgggaatcaccgccgtgcaagggcactttgccgccaaccaaccgatccggctgctcgcagccgatggtcgggaagtggcacgggggttgagctcatggagcagcgaagcgcttcagcgggccctgacccaggccccagccaacgccagcggctcccccgttgtggtgcatcgcgatgccctcgtgctcaccacgcctacgatccgcccgcaggacacctga

SEQ ID NO: 459 - protein, 369 aa, Synechococcus sp. RS9917
MTLRVVKVGTSLLRGDDGSSTSAVIGWLTDALAASLIQGDRTVLVSSGAVGLGCRRLGLSHRPDNVVALQAAAAVGQGHLMSLYEEAMARHGQPVAQVLLTRSDLADRRSYRTASATLHQLLDWGVLPVVNENDTVSSAELRFGDNDTLSALVAAAVEADELILLTDVDRLYTADPRTDANAHPITDVHHPAELARLQDGAGDGGRWGTGGMTTKLAAARIATASGITVHLADGRQPEVLKKLLSGGRGGTVFHPHPEPLGNRKSWLAHALRPQGDLRLDNGACNALEQRGASLLLVGITAVQGHFAANQPIRLLAADGREVARGLSSWSSEALQRALTQAPANASGSPVVVHRDALVLTTPTIRPQDT

SEQ ID NO: 460 - DNA, 1110 bp, Synechococcus sp. WH 5701
  CDS (1)..(1110): transl_table=11
gtgatcaaggtgggcaccagcctgctgcgcggcaccgcccagcgcgacaccgaagcggtgatcgccggcctggccgccagcctcagccggcggcgccagctgggggaggccatcgccctggtcaccagcggtgcggtgggcctgggctgccatgcccttgggtttgggcagcgccccgaggaggtggtggcccttcaggccgccgccgccgtgggccagggccggctgatgcgtctctacgaaacggccttcgcccagcacgacacttccgtggcccaggtgctgctcacccgcggcgacctggcctcccgccgccgctaccagaatgcctgccgcaccctggagcagctgctcagctggggcgtggtgcccgtggtcaacgagaacgacaccctcgccaccgacgaactgcgtttcggcgacaacgacaccctctcggccctggtggcggtggcgatcggcgccgatgagctggtgctgctcaccgatgtggatcggctctattcgggcgatccccgcagcgatgccagtgcccagccgatcgaggaagtgcgcgatctgctggagctggagcgcctcagcggcgtggcccagggcggcgggcgatggggaaccggcggcatgaccaccaagctggccgccgcccgcatcgccacctccagcgggattgccgtgcgcctggccgatggccgcgatccagcggtgctcgaagccctgctggccggcgagcgcctcggcaccctcttccggcccagccccagccccctgcccgaccgcaagggctggctggcccatgccctgctgcccaagggggagctgctgatcgaccccggcgccgagcgggccctgatcgagcggggggcctccctgctggcggtgggcatccgcgccgtcaacggggagttcgaacgccgggatgccgtacggcttctgtctctggaagggcgggagatcggccgcggcctctctgccctcagcagcgctgaggtggcccaggtgctggggctgagcagccaggcggccgagagcaccctggagcacggcgctggcgatgccgtggtccaccgcgaccacctggtgctcaccgcgccggcggcagtcccgggctga

SEQ ID NO: 461 - protein, 369 aa, Synechococcus sp. WH 5701
MIKVGTSLLRGTAQRDTEAVIAGLAASLSRRRQLGEAIALVTSGAVGLGCHALGFGQRPEEVVALQAAAAVGQGRLMRLYETAFAQHDTSVAQVLLTRGDLASRRRYQNACRTLEQLLSWGVVPVVNENDTLATDELRFGDNDTLSALVAVAIGADELVLLTDVDRLYSGDPRSDASAQPIEEVRDLLELERLSGVAQGGGRWGTGGMTTKLAAARIATSSGIAVRLADGRDPAVLEALLAGERLGTLFRPSPSPLPDRKGWLAHALLPKGELLIDPGAERALIERGASLLAVGIRAVNGEFERRDAVRLLSLEGREIGRGLSALSSAEVAQVLGLSSQAAESTLEHGAGDAVVHRDHLVLTAPAAVPG

SEQ ID NO: 462 - DNA, 1113 bp, Pseudoalteromonas tunicata D2
  CDS (1)..(1113): transl_table=11
atgagcgtcagtaaaaccatagtggttaagcttggcacaagtgtgctaacaggtggcagttatacgttagataaagcgcatatggtggagttagtccgccaatgtgcacaattaaggcaacaaggtcacaaagtgattttggtttcaagtggcgcggtggcggcgggtaaagagcacttacacatgagctgcgacttaaacaatttagccaataaacaaatgttggcggcggttggccaatcgcaacttattttaacatggcaaaccttatttaatatttatggtattcatgtcgggcaaatgctgctgactcgcgccgacttagaagaccgagagcgctacttaaatgcgcgcgataccctgcacgccttattaaaacaccatattgtgccgatcattaatgaaaatgatgccgtagccaccgccgaaataaaagtgggtgataacgataatttatcggccttaaccgctattttggctcaagccgatcagttactgttattaactgatcagcccggattatttactgcagatccgcgctcaaatcctgatgcaacccttattactgaagtgaataaaattgatgataatttacgcgcacttgctggtggcagtggtacaaatttaggcacaggtggcatggccactaagttacaagcggccgatgccgcacgccgtgcaggtattgaaaccatcattgcagcagggcacagacccaacgttattattgatacggttaatcaaacaggtgttggcacgcgttttaaagcactcgaatcggcgattgaagggcgaaaacgttggttgcttgcagggccttcaagcagcggtaagcttgtactcgatgctggggcaacggatgccattgtactgcaaggttccagtttattagccaaaggcgtgaagcaagttaaaggcttgtttgagcgtggcgatttagttgagttggtgacagtacaaggtgaagtcattgccaaaggtatttgccgctatagcagcatcgatttagataaaataaaaaccttacattcagagcaaatcaaagccgttttagggtttgataatggcaaagtggtgatccaccgcgatgacttagtgttgctggatgattaa

SEQ ID NO: 463 - protein, 370 aa, Pseudoalteromonas tunicata D2
MSVSKTIVVKLGTSVLTGGSYTLDKAHMVELVRQCAQLRQQGHKVILVSSGAVAAGKEHLHMSCDLNNLANKQMLAAVGQSQLILTWQTLFNIYGIHVGQMLLTRADLEDRERYLNARDTLHALLKHHIVPIINENDAVATAEIKVGDNDNLSALTAILAQADQLLLLTDQPGLFTADPRSNPDATLITEVNKIDDNLRALAGGSGTNLGTGGMATKLQAADAARRAGIETIIAAGHRPNVIIDTVNQTGVGTRFKALESAIEGRKRWLLAGPSSSGKLVLDAGATDAIVLQGSSLLAKGVKQVKGLFERGDLVELVTVQGEVIAKGICRYSSIDLDKIKTLHSEQIKAVLGFDNGKVVIHRDDLVLLDD

SEQ ID NO: 464 - DNA, 1155 bp, Photobacterium sp. SKA34
  CDS (1)..(1155): transl_table=11
atggcagataccaaaaatactaatgctcgagagcaagaccttgcagcatctgctgcatcacaaacaattgttgttaagttgggcaccagtgttctcactggcgggacgctgaagctagatcgcgcccacatggttgagcttgttcgtcaatgtgcgatgcttcgtcgtcaaggacataaaattattattgtcacatctggtgcaattgcagcaggacgtgagcatttaggttaccccgaactgcccaaaacaatggcgagtaagcaattactggcagctgttggtcaaggtcgattaattcaagagtgggaaagcttatttggtatctatgggatcaatattggtcaaatgctattaacgcgtgcagatttacacgatcgtgaacgttatttaaatgcgcgtgatatgttagtcgccttactggataacggcattgttcctgttgtaaatgaaaatgatgcggtagcgacaacagaaattaaagtgggtgataacgataacttatccgcacttgtcggtattttaggcggcgcagataaattattactgatgaccgatcagactggtttatttactgccgatccacgtaataatcctgacgcagagcttatccgcgaagtacatacaattgatgaaacactgcgtaaattagcaggtggtactgttggtggtttaggtactggcggtatggctacaaaactacaggcagctgatgtggctcgtcgagctggtatcgaagtgatcattgctgctggtcgtcgtcctgatgtaatcattgatttagcggaaggtaaatctgtcggtacgcgtttcttaccactggaatcaccattagaaagccgtaagcgttggattttagctgggcctcctcctgcaggtgacattgttattgacgatggtgctgtcattgcagtgcaacaacgtgggagtagtttacttgcaaaagggatcaccatggtaaaaggtgattttgaacgcggtgaagttgtgcgtatctttgataaacaaaataccctattagcacgtggtatttgccgctactcgagtgtagatatggcaaaaattgcaggaaagcatagtcaagaaattcaccttgtgttggggtacgaatatggtcatgtggctatccatcgtgatgatatggtagttatttaa

SEQ ID NO: 465 - protein, 384 aa, Photobacterium sp. SKA34
MADTKNTNAREQDLAASAASQTIVVKLGTSVLTGGTLKLDRAHMVELVRQCAMLRRQGHKIIIVTSGAIAAGREHLGYPELPKTMASKQLLAAVGQGRLIQEWESLFGIYGINIGQMLLTRADLHDRERYLNARDMLVALLDNGIVPVVNENDAVATTEIKVGDNDNLSALVGILGGADKLLLMTDQTGLFTADPRNNPDAELIREVHTIDETLRKLAGGTVGGLGTGGMATKLQAADVARRAGIEVIIAAGRRPDVIIDLAEGKSVGTRFLPLESPLESRKRWILAGPPPAGDIVIDDGAVIAVQQRGSSLLAKGITMVKGDFERGEVVRIFDKQNTLLARGICRYSSVDMAKIAGKHSQEIHLVLGYEYGHVAIHRDDMVVI

SEQ ID NO: 466 - DNA, 1125 bp, Oceanospirillum sp. MED92
  CDS (1)..(1125): transl_table=11
gtggctataggaagggaaaagcttaagcgcagtaagcgttgggtgattaagatcggcagtgcgctgttaaccaatgatggtcagggccttgatcttgaggcgatcagtcgctgggttgatcagatcgcagcacttaaggcgtcgggtcttgaggttgttttggtctcttctggttctgtcgcggaagggatgacgcgtcttggttgggattctcgaccccatgaagtgtctaaattgcaggctgcagctgcggtaggtcaaatgggtctggtgcaggcttatgaggcgaacttccgtcgtcatgaaacgcatacggcgcaaatacttcttacccatgaagatcactctaaccgtaagcgctatctgaatgctcaggcgacgttaaaagagttgctggcactcggtgttgtccctgttgttaatgagaatgatacggttgtaacgaaagagatccgtttcggggataacgatacgcttggggccttggtagctaatttggtgcaggcggatgcgttgatccttctgactgaccaaaagggcttgtttacggcggatccgaggtatgatcctggcgcgatattaatctctgaggcgagagctggagatgaagcgctagaagcgatggcgggggatggcggaaagctgggtcgtggtggtatggcgaccaaagtgcgtgctgctaagttggcggcgcgttccggcgcggtgactgtgattgccagtggtcgtgaagatgatgtgttgttgaggctgcgtgagtcggagcaactaggcaccttgcttgtgcctgaaaaagagccgatggttgcacgtaagcagtggattgccgggcaccttcaggcgcgaggaacattggtgcttgatgagggggcggttaaagcgcttcgtgatcgtggtaaaagtttgcttcctgcgggtgtgcggagcatcagtggtgatttctctcgtggtgagatggtgattatcagtgatgagtatggccgaatcgtagcgcgtggtctggtgaattatggcgtcgaggatgctcagcggatcatgggtaaggctagccgggatatcgagtcagtattgggctttatgggtgaagaagagttagtgcacagagataatcttgtgttggcttaa

SEQ ID NO: 467 - protein, 374 aa, Oceanospirillum sp. MED92
MAIGREKLKRSKRWVIKIGSALLTNDGQGLDLEAISRWVDQIAALKASGLEVVLVSSGSVAEGMTRLGWDSRPHEVSKLQAAAAVGQMGLVQAYEANFRRHETHTAQILLTHEDHSNRKRYLNAQATLKELLALGVVPVVNENDTVVTKEIRFGDNDTLGALVANLVQADALILLTDQKGLFTADPRYDPGAILISEARAGDEALEAMAGDGGKLGRGGMATKVRAAKLAARSGAVTVIASGREDDVLLRLRESEQLGTLLVPEKEPMVARKQWIAGHLQARGTLVLDEGAVKALRDRGKSLLPAGVRSISGDFSRGEMVIISDEYGRIVARGLVNYGVEDAQRIMGKASRDIESVLGFMGEEELVHRDNLVLA

SEQ ID NO: 468 - DNA, 1161 bp, Xanthobacter autotrophicus Py2
  CDS (1)..(1161): transl_table=11
atgacatcgacagattcgacatcagatccgacggctccgaagacccccgtcttcaccgacttccgccgcatcgtcatcaaggtgggctccgccctgctggtggaccgcgaccacgggcgggtgaagctcgcctggctcacctcgctggtggaggacatcgcgacgctccatgcccgcggctgcgaggtgatggtggtgtcttcgggcgctatcgctttggggcgcaccgtgctcggcctgcccaaggggccgctgaagctggaggacagccaggccgccgccgccgtgggccagatcaccctgtcgcgcacctgggcgcagattctcgggcattacggcattaccgccggccaggtgctgctgaccctgggcgacaccgaggagcgccggcgctatctcaacgcccgctccaccctcggccggctgatggacctcaaggcggtacccatcatcaacgagaacgacacggtggccaccaccgagatccgctacggcgacaacgaccgcctcgccgcccgggtcgccaccatggccagcgccgacctgctggtgctgctctcggacatcgacgggctctataccgccccgccggcgcaggacccctccgccaccctcatcccggtggtgccgcgcatcggcgcggagatcgaggccatcgccggggatgccggctccgagctgtcgcgcggcggcatgcgcaccaagatcgaggccggcaagatcgccacctccgccggcacccacatggtcatcgcctccggccatgcgaagaacccgctgaagcggatccgggagggcgggcgctgcacctggttcctcacctccgccaatccggtgcgcgcccgaaagagctggatcgccggggcgctggagccgcgcggcacgctgcacctggacgacggggccgtggcggcgctgcgccggggcgccagccttctgccggccggggtgaaacgggtggaaggcctgttcgaccgcggcgacgcggtggtgctgcgcggccccgacggcgccgaggtgggccgggggctggtggcctacgactccacccacgccgcccgcatcatgggccgctccacccacgagatcgaggcgctgctgggcgtccccggccgctccgagatggtgcaccgggacgacatggccctcggggtggagtga

SEQ ID NO: 469 - protein, 386 aa, Xanthobacter autotrophicus Py2
MTSTDSTSDPTAPKTPVFTDFRRIVIKVGSALLVDRDHGRVKLAWLTSLVEDIATLHARGCEVMVVSSGAIALGRTVLGLPKGPLKLEDSQAAAAVGQITLSRTWAQILGHYGITAGQVLLTLGDTEERRRYLNARSTLGRLMDLKAVPIINENDTVATTEIRYGDNDRLAARVATMASADLLVLLSDIDGLYTAPPAQDPSATLIPVVPRIGAEIEAIAGDAGSELSRGGMRTKIEAGKIATSAGTHMVIASGHAKNPLKRIREGGRCTWFLTSANPVRARKSWIAGALEPRGTLHLDDGAVAALRRGASLLPAGVKRVEGLFDRGDAVVLRGPDGAEVGRGLVAYDSTHAARIMGRSTHEIEALLGVPGRSEMVHRDDMALGVE

SEQ ID NO: 470 - DNA, 1122 bp, marine gamma proteobacterium HTCC2207
  CDS (1)..(1122): transl_table=11
atgacaagaacaatcacccaagatgcacagcgcctagtcgttaagattggcagtgcgttgctgaccaataacggcgcaggcctggatcgcgacgccatcgacggctgggtggagcaaatcgctcagctattggctcagggtaaagaaattgttttggtctcctcagggtcaattgccgaaggcatagtgcgacttggctggaaaacccgtcccgagagcattcatgagcttcaagccgctgccgcagtaggccagatgggcctgatccaaacctatgagagtagctttaagcgctttgatcgactcactgcacagatacttctagaccatgacgacctagccaatcgccagcgctacctcaatgcgcgcagcgcactgcagacactaatccagttaaatgtcgtgcccatagtcaacgagaatgacaccgtagtcaccgacgaaattcgctttggtgacaatgacagcctagctgcattggtggccaacctgatcgatgcagacctgctagtgatcctcactgacaaagacggtctctacagtgccaatcccgacctagatccgcacgctcagctgatcagcgaagccatggccgacgatagcgctctcgatgccttagcggggggcagcaacagtgcccttggtcgtggcggcatgataaccaaattgcaggccgctaggctggcggcacgctctggttgcaatacgataattgttggtggccgcaacagcggtatattaacagcagtctctgaaggtgccgaagttggaacattactgaccgcctctcagcaacccttggccgcacgtaaacagtggctggcggggcagcttcaagtaaaaggccagctggtgttagatgccggtgcaattaaagttctgcaacagcagggtcgtagcttactggccgttggtgtgactcaggtcaaagggcaatttacccgtggcgaattggtaagctgcatggatgctaatggtcaggaaattgcccgtgggttggtgaattataactctgatgaggcaacccgtattcagggacagagcactgagcgcatagccgaaattctcgggtatcgtgaagatgatgagcttatccatcgcgacaatatggttgttagctag

SEQ ID NO: 471 - protein, 373 aa, marine gamma proteobacterium HTCC2207
MTRTITQDAQRLVVKIGSALLTNNGAGLDRDAIDGWVEQIAQLLAQGKEIVLVSSGSIAEGIVRLGWKTRPESIHELQAAAAVGQMGLIQTYESSFKRFDRLTAQILLDHDDLANRQRYLNARSALQTLIQLNVVPIVNENDTVVTDEIRFGDNDSLAALVANLIDADLLVILTDKDGLYSANPDLDPHAQLISEAMADDSALDALAGGSNSALGRGGMITKLQAARLAARSGCNTIIVGGRNSGILTAVSEGAEVGTLLTASQQPLAARKQWLAGQLQVKGQLVLDAGAIKVLQQQGRSLLAVGVTQVKGQFTRGELVSCMDANGQEIARGLVNYNSDEATRIQGQSTERIAEILGYREDDELIHRDNMVVS

SEQ ID NO: 472 - DNA, 1119 bp, Oceanobacter sp. RED65
  CDS (1)..(1119): transl_table=11
atgagccgtcaatctgttgcgaacgcaaagcgcattgttattaaaattggtagtgcgcttttaaccaatgacggcgccggcttaaataaagcaggcatcgccaactgggtggaccaaattgctgaactcaaggcccagggaaaagaaataatccttgtatcttctggctctgtggcagaaggtatgacacgcttgggatggtctgaacggcctaccgccttacatgaattacaagccgctgcagctgttggccaaatgggtttggttcaatgttatgaaagtaatttctctcgccatcagtatgtcaccgcacaagtactattgactcacgctgacctcagcaaccgaacacgctatcttaatgcgcgttctgccattacgtcgctgttatcgtttggagttgtgcctatcattaatgaaaacgatacggtaatcaccgatgagattcgttttggcgataatgatacgctcggggctttagtcgccaatttgatagaggctgatgcgctgatcattttgacagaccaggacggactctataccgcggatcctcgcaaagataaaaacgccaagctcattgagcaagctcgcgctgaagatccagatattgaagccgtagctggcggtggcggcaagttggggcgtggcggtatgacgacaaaagtgcgcgctgcaaaattggcggctcgttctggttgttttactgtgatagtgggtggtcgtattgaaaacgtcattacgcgcttaaataaagatgaagttttgggtacgcttttgtgtagtgatcaagagcccatggcggcgcgcaagcagtggcttgccggtcacttacaaacccgaggtcaaattacattggacccaggagcagttagagccgtgattgaacagggtagaagcttgctatcagtgggcgtggttcatgtggacggaaattttgggcgcggtgaagtagttgcttgtattaatgagcaaggtcaaatcattgcgaaaggtttgatcaattataacgcccttgaaacgcagaaaatcatgggtaaagaaagtaaagaaatcctcgatattcttggttacatggatgaacccgagttgattcaccgagataacttggttttagtataa

SEQ ID NO: 473 - protein, 372 aa, Oceanobacter sp. RED65
MSRQSVANAKRIVIKIGSALLTNDGAGLNKAGIANWVDQIAELKAQGKEIILVSSGSVAEGMTRLGWSERPTALHELQAAAAVGQMGLVQCYESNFSRHQYVTAQVLLTHADLSNRTRYLNARSAITSLLSFGVVPIINENDTVITDEIRFGDNDTLGALVANLIEADALIILTDQDGLYTADPRKDKNAKLIEQARAEDPDIEAVAGGGGKLGRGGMTTKVRAAKLAARSGCFTVIVGGRIENVITRLNKDEVLGTLLCSDQEPMAARKQWLAGHLQTRGQITLDPGAVRAVIEQGRSLLSVGVVHVDGNFGRGEVVACINEQGQIIAKGLINYNALETQKIMGKESKEILDILGYMDEPELIHRDNLVLV

SEQ ID NO: 474 - DNA, 1143 bp, Acidovorax sp. JS42
  CDS (1)..(1143): transl_table=11
atggtgtccagtgtattgcgcgacgcgcgtcgcatcgtggtcaaggtagggtccagtctcgtcacgaatgagggacgggggctggacgaggtggccattggggagtggtgccgccaactggcagcgctggtgcgggggcaggggggcgagccgcgcgaggtcatcatggtctccagcggagcgatcgccgaaggcatgaagcgcctgggctggagcagccgccccggcgagatccacgaactgcaggccgctgccgccgtgggacagatggggctggcgcagatgtacgagaccaagctgcgcgagcaatccatgggcagtgcgcaggtgctgctgacccatgccgacttggcggaccgcgagcgctacctgaatgcccgctccaccctgctgacgctgctgcgcctgggcgtggtgccggtgatcaatgagaacgacaccgtagtcaccgatgagatcaagtttggtgacaacgatactctgggggctctcgtcgccaacctcgtcgaagccgacgcgctggtgatcctgaccgaccagaaggggctgtacaccgccgatccgcggcgcgacccgcaggcgcagttcgtccacgaggcacaggctggcgatgcggcgctggaggcgatggccggcggcgcgggctccagcatcggcaagggcgggatgatcaccaagatcctcgcggccaaacgtgcggcgggctcgggtgcttccaccgtcatcgcatgggggcgggagccggacgtgctgctgcggctggcccggggcgaatcgatcggcacgttgctcgtggcgcagacgcagaagaaccaggcgcgcaagcagtggatggtggaccacctgcaactgcgcggctccgtgacggtggatgccggcgcggcggccaagctgcgcgaagacggcaagagcctgctgccgatcggcatggtggcggtggagggcgacttcgtgcgcggcgatgtgatcgcggtgcgcgaccccggcggcacagagatcgcccgcggtctcgccaactatgcgagcgccgaggcgcgcctgctgtgccgcaagccttccgcagagtttgagcgcctgctggggtacgcggccgaaccggagatggttcaccgcgacaacatggtggtgctcggcgcgcgatga

SEQ ID NO: 475 - protein, 380 aa, Acidovorax sp. JS42
MVSSVLRDARRIVVKVGSSLVTNEGRGLDEVAIGEWCRQLAALVRGQGGEPREVIMVSSGAIAEGMKRLGWSSRPGEIHELQAAAAVGQMGLAQMYETKLREQSMGSAQVLLTHADLADRERYLNARSTLLTLLRLGVVPVINENDTVVTDEIKFGDNDTLGALVANLVEADALVILTDQKGLYTADPRRDPQAQFVHEAQAGDAALEAMAGGAGSSIGKGGMITKILAAKRAAGSGASTVIAWGREPDVLLRLARGESIGTLLVAQTQKNQARKQWMVDHLQLRGSVTVDAGAAAKLREDGKSLLPIGMVAVEGDFVRGDVIAVRDPGGTEIARGLANYASAEARLLCRKPSAEFERLLGYAAEPEMVHRDNMVVLGAR

SEQ ID NO: 476 - DNA, 1140 bp, Vibrio sp. Ex25
  CDS (1)..(1140): transl_table=11
atgacaacgaatcaacaaaatgcagttgtttcacaaccacaaactgtcgttgtgaaactgggtacaagtgtgctgacaggcggcactctggcactcgaccgtgctcacatggttgagttagcgcgccagtgtgctgagcttaaaaaacaaggccattcagtggtaatggtttcgtctggtgctattgcagcaggtcgtgagcaccttggttaccccgcattgcccaacgagatggcgagtaaacaattacttgcggcggtgggtcaaagtcgcttgattcaaacatgggagtctttgtttggtatttacggcattaagattggtcaaatgctactaactcgtgctgatttagaagatcgcgagcgattcttaaacgcacgtgacaccatcaatgcgctcgttgcgaacgatattattcctatcgtaaacgaaaatgatgccgttgcgaccagcgagattaaagtgggcgataacgacaacctttccgctttggtgggcattttgtgtggcgcagataagctcttgcttttaactgaccaaaaaggtctgtttactgctgaccctcgtaaagacccgaacgcagagctgatcaaggaagtaaaaaccatcgacgatacgctgcgtaaaatcgcaggaggaagtggtacaacgttgggtacaggcggtatggcaacgaagctgcaagccgcagacatcgctcgccgcgctggtatcgaggttattattgctgccggtagtgcaccgaatgttatctttgactctttgagtgcagagccacaaggcacgcgcttcctaccttgcgctgaagctttagaaaaccgtaaacgctggattctggcgggacctgcggcatcgggcgacatcattattgatgatggtgcggtaaatgcagtggtcggtaagggcagtagcctacttgctaaaggggtaatcaaagtaagtggtgactttgcacgaggcgaagtggcgcgtgtaacaaattctcacggtaagttggtggctcgtggcatcagcgcctactcaagtgatgacctaactaaaattactggtaagcacagtaaagatatcatctctattttggggcatgattatggctctgaggtgattcatcgcgatgatttggtcgtcattcaggaatag

SEQ ID NO: 477 - protein, 379 aa, Vibrio sp. Ex25
MTTNQQNAVVSQPQTVVVKLGTSVLTGGTLALDRAHMVELARQCAELKKQGHSVVMVSSGAIAAGREHLGYPALPNEMASKQLLAAVGQSRLIQTWESLFGIYGIKIGQMLLTRADLEDRERFLNARDTINALVANDIIPIVNENDAVATSEIKVGDNDNLSALVGILCGADKLLLLTDQKGLFTADPRKDPNAELIKEVKTIDDTLRKIAGGSGTTLGTGGMATKLQAADIARRAGIEVIIAAGSAPNVIFDSLSAEPQGTRFLPCAEALENRKRWILAGPAASGDIIIDDGAVNAVVGKGSSLLAKGVIKVSGDFARGEVARVTNSHGKLVARGISAYSSDDLTKITGKHSKDIISILGHDYGSEVIHRDDLVVIQE

SEQ ID NO: 478 - DNA, 1104 bp, Alteromonadales bacterium TW-7
  CDS (1)..(1104): transl_table=11
atgcaaagggaacagataatagttgtaaagttaggtacgagcgtactaactggtggcaccaataaactagataaagcccatatggttgagttagttcgccaatgctgcgagcttaaaaagcaggggcatcaggttgttatggtatcgagcggcgccgtagctgcaggccgtgagcaactattaaaatcctgtggtacgagcttagtggataaacaaatgttagccgccattgggcagggccaacttattcatatatggcaaagtttgtttgccttgtatggtgtaaacgtagggcaaatgctgctaacacgcgctgatgttgatgtcagggagcgctacttaaacgcacgcgatacattaacggccttacttagttacaacgtggtgcctattataaatgaaaacgatgcggtggcgacgagcgaaataaaagtgggtgataacgataacctatcggccttggtggctatattagctaatgcagacaaattactattacttaccgatcaagacggcttgtttaccagcgatccgcgcaccaatgccgatgcaaagcttattgacgaagtaacccacataaacgatgagctgcgtcaacttgctggtggcagcggcacaaacttaggcactggcggtatggcaacaaagctgcaagcggctgatatagcaaggcgtgcaggcgttgaagtcattattgccaaaggcgctggcagcaacgttattttaaaatgcatgagcgagcaattaccgggtactcgctttttaaagttaacagcgcctaaagatggtcgcaaaaaatggttattagccgggcctaaaagcaatgggcaaatagcaatagacgcaggcgctattcgtgcgctgcaaaataatggggcaagtttattggccaaaggagtcacttgtgcctttggggattttgagcgtggtgatttaatagatttgattgatacaaataaccaagtaattgcgcgtggtttaacccgctttagtcgctcggaggttaataaaattaaaggcgcacattcaaaaaatattgcacagttacttagttatgacgctggggcagaagtattacatagggatgatttggtactactttaa

SEQ ID NO: 479 - protein, 367 aa, Alteromonadales bacterium TW-7
MQREQIIVVKLGTSVLTGGTNKLDKAHMVELVRQCCELKKQGHQVVMVSSGAVAAGREQLLKSCGTSLVDKQMLAAIGQGQLIHIWQSLFALYGVNVGQMLLTRADVDVRERYLNARDTLTALLSYNVVPIINENDAVATSEIKVGDNDNLSALVAILANADKLLLLTDQDGLFTSDPRTNADAKLIDEVTHINDELRQLAGGSGTNLGTGGMATKLQAADIARRAGVEVIIAKGAGSNVILKCMSEQLPGTRFLKLTAPKDGRKKWLLAGPKSNGQIAIDAGAIRALQNNGASLLAKGVTCAFGDFERGDLIDLIDTNNQVIARGLTRFSRSEVNKIKGAHSKNIAQLLSYDAGAEVLHRDDLVLL

SEQ ID NO: 480 - DNA, 1125 bp, marine gamma proteobacterium HTCC2143
  CDS (1)..(1125): transl_table=11
atgaccgcacgacaaaatttgcaacaaacccgacgatgggttgtgaaaataggcagcgctttgctgaccgctgatggcaagggtcttgactcgtccgccattgctgattggacgcgccaaatggcggagttgagagggcgtggtattgagttggtattggtgtcttctggcgctgttgccgagggtatgagccggttgggttggagtacccgtccgcacgctttgcatcatcttcaggctgccgctgccgttggtcaaatggggttggtgcaggcttatgagtcatgctttcaacaatttggcttgcataccgcacaagttcttttaggtcacgatgacatatcagctcgtgatcgttatcttaatgcccgtagtacactgacaacattgttggagttaggtgttgttcccgtggtgaatgaaaacgataccgttgtcaccgaagagatacggtttggcgacaacgataccctcgcggcattggtcgccaaccttatcgatgctgaagtgctggtgatcttaacggaccagcaggggttattcgatgccgacccaagaatcaatcctactgcaaagctggtgacagaggcgttggtgagtgatcctagccttgagagtatggcgggtggcagcagtggcgaactgggccaagggggaatgataaccaaggtgagagcatcaaagttggctgcgcgctctggcgctaatacggtgattgccagcggtaaggtcgacgatgtactgctgagtattgccgcgggccagtcggtagggaccttgttgactgccgagcaggcgccactaattgctcgtaaacagtggttggcgggcatgtctaatattaaaggtacggtacagttggatgatggcgccgttaaaatgctgcaacaggccggaaaaagtctgctgcctgttggtgttggagcggtgaccgggcattttgatcggggcgacttgatccgttgtatcgatagcaatggccaggaaattgcccgggggctggtaaactataagttcgatgaagtgaataaaattattggcaaaagcagtagtcagattgaaggcttgctgggctatcagggtgatgaggagttgatccaccgcgataatctggtattgatgtag

SEQ ID NO: 481 - protein, 374 aa, marine gamma proteobacterium HTCC2143
MTARQNLQQTRRWVVKIGSALLTADGKGLDSSAIADWTRQMAELRGRGIELVLVSSGAVAEGMSRLGWSTRPHALHHLQAAAAVGQMGLVQAYESCFQQFGLHTAQVLLGHDDISARDRYLNARSTLTTLLELGVVPVVNENDTVVTEEIRFGDNDTLAALVANLIDAEVLVILTDQQGLFDADPRINPTAKLVTEALVSDPSLESMAGGSSGELGQGGMITKVRASKLAARSGANTVIASGKVDDVLLSIAAGQSVGTLLTAEQAPLIARKQWLAGMSNIKGTVQLDDGAVKMLQQAGKSLLPVGVGAVTGHFDRGDLIRCIDSNGQEIARGLVNYKFDEVNKIIGKSSSQIEGLLGYQGDEELIHRDNLVLM

SEQ ID NO: 482 - DNA, 1128 bp, marine gamma proteobacterium HTCC2080
  CDS (1)..(1128): transl_table=11
ttgatcacagatgatcgccagattttactgactgcgcgccgttgggtcgtcaaagtgggtagtgctttattaaccgcagatggtcgtcgcctcgataaaggcgttattcatggtttggtgcagcagctgatcactttgcgagagcgaggctgcgaagtggtgctggtttccagcggtgccgtagcagcaggtgcggttcggctagggtttgaagatcgtccagaggacctccattcgttgcaggcggccgccgctgttggtcagtcagcgctgatccgcagttacgaggaggcactggctcctcagggcattaacacggctctcgttttgctgagccacgccgatattctcgcaagagaccgttacctcaatgctcgtggaacactggggcgcctgatcgatttgggcgttatcccggttgtgaacgaaaatgattcggtggtcaccgatgaaattcgcctcggtgataacgacaccttggcggcgttggtggcaaatttgatagacgccgatgtcctgctagtgctcaccgaccaggacgggctttgtgacgcaaatcctcgtgaaaatccagacgcggctgtaatttcggccgcggaggttgatgacccccgactggacacaatggttggtgaaggcggccagtttggacggggcggtatggttaccaaactcaatgctgctcgattggcagcgcgatcaggtgcggtaaccgtgattgctaatggtcgagtacccgaggtcattcccaaggtggccgcgggagagcaattaggcactctgctaagtactcggcatcggccgcaaagtgctcgtaagcagtggttagctagcttgcttcacattcaagggcgccttgtgcttgacgctggtgcggctgccgttgtggctgcgggggataagtcacttcttcccgtgggggttatttccgtagagggcgattttgtgcggggtgacctggtggcctgtgtggatgttgatgggcgccaaattgctcgaggtctagttaactacagtgccgaggaagcgcttcaattgcagggtaagccgtccaaggatatccccgttattctcggctatggtggcgacgcagagattattcatcgcgacaacatggtgagtgtatga

SEQ ID NO: 483 - protein, 375 aa, marine gamma proteobacterium HTCC2080
MITDDRQILLTARRWVVKVGSALLTADGRRLDKGVIHGLVQQLITLRERGCEVVLVSSGAVAAGAVRLGFEDRPEDLHSLQAAAAVGQSALIRSYEEALAPQGINTALVLLSHADILARDRYLNARGTLGRLIDLGVIPVVNENDSVVTDEIRLGDNDTLAALVANLIDADVLLVLTDQDGLCDANPRENPDAAVISAAEVDDPRLDTMVGEGGQFGRGGMVTKLNAARLAARSGAVTVIANGRVPEVIPKVAAGEQLGTLLSTRHRPQSARKQWLASLLHIQGRLVLDAGAAAVVAAGDKSLLPVGVISVEGDFVRGDLVACVDVDGRQIARGLVNYSAEEALQLQGKPSKDIPVILGYGGDAEIIHRDNMVSV

SEQ ID NO: 484 - DNA, 1128 bp, Cyanothece
  CDS (1)..(1128): transl_table=11
atgaaccactcccagactatcgttattaaaattggtacctctagtcttgctcaaccagagacaggaaaattagctttatcaactattgctgctcttgtggaaactttaacagaattacgacaattaggctacgatgttgttttagtttcatctggtgcagtgggagtgggttgtagtcgtttaaagttaacagaaagacccaaaaaaatagccaccaaacaagcgattgccgccgtaggacaaggccgattaattcgggtttatgatgacctttttaccgctttaaatcaacccattgctcaaattttgttaactcgtagagaattaatggaacggagttgttatgtcaatgctaaaaatacctttgatgcgctgtttgaattaggggttattcctattgttaatgaaaacgatacggtggctattgaagagttaaaatttggagataatgataccctttctgctttagtcgctagtttaattaatgccaattggttgtttattttaacggatgttgatcgactttattcagctgatcctcgcacttttcctgatgctaaacctatcaaagttgttaacagtttacaattagaccaattacaagttaaagcagggaataaaggatctcaatggggaacaggaggaatgtcaaccaaactcacagcagcaagactggctacatctgtaggggtgaccacggttatcacccacggaaaaaaaccagaaaacttattaaaaataattaatggagaagatattggcaccaaatttgaggcacaattaaagaatgataatgctcgaaaacgttggatcgcctatggtttattacctagaggaaaattgtatctcgataagggtgcagttaaagcgatttctcaaaaaggaaagtctttgttagcagcaggaattcttaaagtcgaaggcagttttgattcagcagatgcagttcaattgtgtgatgaaactggtcaagaaattgctagaggtattgttaattataatcaagaagagattaataaaataaaaggaaatcactccaatcaaattccagaattattagggtatgatggaggagggactattgtacatcgagataatttagttattaatggaacttttaaaaattaa

SEQ ID NO: 485 - protein, 375 aa, Cyanothece
MNHSQTIVIKIGTSSLAQPETGKLALSTIAALVETLTELRQLGYDVVLVSSGAVGVGCSRLKLTERPKKIATKQAIAAVGQGRLIRVYDDLFTALNQPIAQILLTRRELMERSCYVNAKNTFDALFELGVIPIVNENDTVAIEELKFGDNDTLSALVASLINANWLFILTDVDRLYSADPRTFPDAKPIKVVNSLQLDQLQVKAGNKGSQWGTGGMSTKLTAARLATSVGVTTVITHGKKPENLLKIINGEDIGTKFEAQLKNDNARKRWIAYGLLPRGKLYLDKGAVKAISQKGKSLLAAGILKVEGSFDSADAVQLCDETGQEIARGIVNYNQEEINKIKGNHSNQIPELLGYDGGGTIVHRDNLVINGTFKN

SEQ ID NO: 486 - DNA, 1131 bp, uncultured archaeon GZfos36D8
  CDS (1)..(1131): transl_table=11
atggcgggagttagggacatatcaaaagcgaaaaggattgtaataaaagttggaaccagcaaccttacggataagagctatcggcttgacccgcgaaaagtcgaaaaactcgctaaggagataattgaactgaaaaataagggtaaggaagtcattgtcgtaacgtcaggcgctatcggtgccggtatcggtaagctcgacctgaagcaaagaccccgcgacattaaagtattgcaggctacggctgccgtcggtcagaacatcctgatgagcacgtatgataaatattttgccaaatacgatcagactatcgctcaactcttattgacgcatgataatttctttaaccggcagaggtaccttaaccttagaaatacattgattacattgcttaagtctggtgtaatcccaataatcaacgagaacgataccgtagcagtggatgaaatcaaattaggtgataatgataatttatctgccctggtggcgagcagcctcggcgcggatttacttattatactgaccgacatagatggcttatacacttatgacccaaaaaggagcgaaaaagcggaattcatttcggttgtggaagatataacgccggagattgagcgaattgcctcgggcagaggaaagacaggtgtgggtggaatgaagacaaaagttcaggctgctgaagtcactatgaaagcaggtattccgatgatcattgcaaacggaggtgagaaaaacatcctctctcgggttatagcaggagaaccggtggggacgttattcatgcccaaaaagaaaagaatgaacgataaagagcactggattctattctccgcatcgccaaagggcaagattaaggtggatgaaggtgcaaaaaccgctctggtagaaggaggcggtagtttgcttccttccggtatcaccgacgttgaagatgaattcatgcgtggcgaccccgtgagcattattgactcccggagcgtggaattcgccagaggcattacaaactactcctccgcggaaataaaaaagattaaaggtgtgcaatcaaaagaaatcgagcaaattctgggtcgtaaagattacggatacggcgaagtagtagtttatagaggtaatctcgtgttgttataa

SEQ ID NO: 487 - protein, 376 aa, uncultured archaeon GZfos36D8
MAGVRDISKAKRIVIKVGTSNLTDKSYRLDPRKVEKLAKEIIELKNKGKEVIVVTSGAIGAGIGKLDLKQRPRDIKVLQATAAVGQNILMSTYDKYFAKYDQTIAQLLLTHDNFFNRQRYLNLRNTLITLLKSGVIPIINENDTVAVDEIKLGDNDNLSALVASSLGADLLIILTDIDGLYTYDPKRSEKAEFISVVEDITPEIERIASGRGKTGVGGMKTKVQAAEVTMKAGIPMIIANGGEKNILSRVIAGEPVGTLFMPKKKRMNDKEHWILFSASPKGKIKVDEGAKTALVEGGGSLLPSGITDVEDEFMRGDPVSIIDSRSVEFARGITNYSSAEIKKIKGVQSKEIEQILGRKDYGYGEVVVYRGNLVLL

SEQ ID NO: 488 - DNA, 1131 bp, uncultured archaeon GZfos32E4
  CDS (1)..(1131): transl_table=11
atggcgggagttagggacatatcaaaagcgaaaaggattgtaataaaagttggaaccagcaaccttacggatacgagctatcggcttgacccgcgaaaagttgaaaaactcgctaaggagataattgaactgaaaaatgagggtaaggaagtcattgttgtaacgtcaggcgctatcggtgccggtatcggtaagctcgatctgaagcaaagaccccgcgacattaaagtattgcaggctacggctgccgtcggtcagaacatcctgatgagcacgtatgaccggtattttgccaaatacgagcagactatcgctcaactcttattgacgcatgataatttctttaaccggcagaggtacctcaacctcagaaatacattgattacattgcttaagtctggtgtaatcccaataatcaacgagaacgacaccgtagcagtggatgaaatcaaattaggtgataatgataatttatctgccctggtagcgagcagcctcggtgcggatttacttattatactgaccgacatagatggcttgtacacttatgaccccaaaaggagcgaaaaagcggaattcatttcggttgtggaagatataacgccggagattgagcgaattgcctcgggcagaggaaagacaggtgtgggtggaatgaagacaaaagttcaggctgctgaagtcactatgaaagcaggtattccgatgatcattgcaaacggcggtgaggaaaacatcctctctcgggttatagcaggagaaccagtgggaacgttattcatgcccaaaaagaaaaggatgaacgataaagagcactggattctattctccgcatcgccaaagggcaagattaaggtggatgaaggtgcaaaaaccgctctggtagaaggaggcggtagtttgcttccttccggtatcaccgacgttgaagatgaattcatgcgtggcgaccccgtgagcattgttgacgcccggagcgtggaattcgccagaggcattacaaactactcctccgcggaaataaaaaagattaaaggtgtgcaatcaaaagaaatcgagcaaattctgggtcgtaaagattacggatacggcgaagtagtagtttatagaggtaatctcgtgttgttataa

SEQ ID NO: 489 - protein, 376 aa, uncultured archaeon GZfos32E4
MAGVRDISKAKRIVIKVGTSNLTDTSYRLDPRKVEKLAKEIIELKNEGKEVIVVTSGAIGAGIGKLDLKQRPRDIKVLQATAAVGQNILMSTYDRYFAKYEQTIAQLLLTHDNFFNRQRYLNLRNTLITLLKSGVIPIINENDTVAVDEIKLGDNDNLSALVASSLGADLLIILTDIDGLYTYDPKRSEKAEFISVVEDITPEIERIASGRGKTGVGGMKTKVQAAEVTMKAGIPMIIANGGEENILSRVIAGEPVGTLFMPKKKRMNDKEHWILFSASPKGKIKVDEGAKTALVEGGGSLLPSGITDVEDEFMRGDPVSIVDARSVEFARGITNYSSAEIKKIKGVQSKEIEQILGRKDYGYGEVVVYRGNLVLL

SEQ ID NO: 490 - DNA, 1131 bp, uncultured archaeon GZfos28G7
  CDS (1)..(1131): transl_table=11
atggcgggagttagggacatatcaaaagcgaaaaggattgtaataaaagttggaaccagcaaccttacggatacgagctatcggcttgacccgcgaaaagtcgaaaaactcgctaaggagataattgaactgaaaaatgagggtaaggaagtcattgttgtaacgtcaggcgctatcggtgccggtatcggtaagctcgatctgaagcaaagaccccgcgacattaaagtattgcaggctacggctgccgttggtcagaacatcctgatgagcacgtatgaccggtattttgccaaatacgagcagactatcgctcaactcttattgacgcatgataatttctttaaccgacagaggtaccttaaccttagaaatacattgattacattgcttaagtccggtgtaatcccaataatcaacgagaacgacaccgtagcagtggatgaaattaaattaggtgataatgataatttatctgccctggtggcgagcagcctcggcgcggatttactcattatactgaccgacatagatggcttatatacttatgacccaaaaaggagcgaaaaagcggaattcatttcggttgtggaagatataacgccggagattgagcgaattgcctcgggcagaggtaaaacaggtgtgggtggaatgaagacaaaagttcaggctgctgaagtcaccatgaaagcaggtattccaatggtcattgcaaacggcggtgaagaaaacatcctcaggcgggttatagcaggagaaccggtgggaacgttattcatgcccaaaaagaaaaggatgaacgataaagagcactggattctattctccgcatcgccaaagggcaagattaaggtggatgaaggtgcaaaaaccgctctggtagaaggaggcggtagtttgcttccttccggtatcaccgacgttgaagatgaattcatacgtggggaccccgtgagcattattgacgttcagagcgtggaattcgccagaggcattacaaactactcctccgcggaaattaaaaagattaaaggtgtgcaatcaaaagaaatcgagcaaattctgggtcgtaaaggttacggatacggcgaagtagtagtttatagaggtaatctcgtgttgttataa

SEQ ID NO: 491 - protein, 376 aa, uncultured archaeon GZfos28G7
MAGVRDISKAKRIVIKVGTSNLTDTSYRLDPRKVEKLAKEIIELKNEGKEVIVVTSGAIGAGIGKLDLKQRPRDIKVLQATAAVGQNILMSTYDRYFAKYEQTIAQLLLTHDNFFNRQRYLNLRNTLITLLKSGVIPIINENDTVAVDEIKLGDNDNLSALVASSLGADLLIILTDIDGLYTYDPKRSEKAEFISVVEDITPEIERIASGRGKTGVGGMKTKVQAAEVTMKAGIPMVIANGGEENILRRVIAGEPVGTLFMPKKKRMNDKEHWILFSASPKGKIKVDEGAKTALVEGGGSLLPSGITDVEDEFIRGDPVSIIDVQSVEFARGITNYSSAEIKKIKGVQSKEIEQILGRKGYGYGEVVVYRGNLVLL

SEQ ID NO: 492 - DNA, 1272 bp, Saccharomyces cerevisiae
  CDS (1)..(1272)
atgacaaaagcttatactatcgttatcaagctgggcagttcgtcgctcgtcgacgagagcacaaaagagccaaagttgtccatcatgacgttaatcgtcgagaccgtgacgaatcttaagcgcatgggccacaaagtgatcatcgtatccagcggcggcattgccgttggtttggacgctctcaacattccgcacaagcctaagcagttgtctgaagtgcaagcgattgccgctgtcggacaaggccgtctcatcgcgcgctggaacatgctgttttcccagtatggcgagcaaacagcgcagatcctgctcacgcgcaacgatatactgcgttggaaccagtacaatgacgcacgcaatacaatcaacgaactgctggccatgggtgtcatccctatagtcaacgaaaacgatacgctatccattagcgagatcgagttcggcgataacgacacgctttctgccattaccgctgctcttgtaggggcggatttcctgttcttgctcacagatgtggactgcctatatacagacaatccgcgcactaatccggatgctcgtcctattgttctcgtgccagagctatcagagggccttccgggcgtcaacacttccagtggttcaggctccgaggttggcacgggcggaatgcgcaccaaactcatagccgccgacctcgcctctaatgccggtatcgagactattgtgatgaagagcgaccgtccagagtacgtcccgaagatcgttgactacattcagcatcacttccgccctccgcgccatatcggaaacggcacacagcagcagtttctcgatcttcaggatacggagctcgaacagttgcgtcgctacgatgttcccatgcacaccaagttcttagctaatgacaacaaacacaagcttaagaacagggaattttggattctgcacgggctcattaccaagggcgccattatcatcgacgagaacagctatgataaacttttgtcaaaggatatggctagtctgactccaaacgccgtgatcgaagtccgagacaacttccacgaacttgaatgcgttgatctcaaaataggccagcggttacccaatggcgaattggatatctcgaagccgattcagtctgttggatgcgtccgttccaattatacgagtctggagcttgcgaagatcaagggcttacccagtgagaagattcacgatgttttgggctacagtgtgagtgaatacgtagcacatagagaaaacatcgctttccctccgcaattttga

SEQ ID NO: 493 - protein, 423 aa, Saccharomyces cerevisiae
MTKAYTIVIKLGSSSLVDESTKEPKLSIMTLIVETVTNLKRMGHKVIIVSSGGIAVGLDALNIPHKPKQLSEVQAIAAVGQGRLIARWNMLFSQYGEQTAQILLTRNDILRWNQYNDARNTINELLAMGVIPIVNENDTLSISEIEFGDNDTLSAITAALVGADFLFLLTDVDCLYTDNPRTNPDARPIVLVPELSEGLPGVNTSSGSGSEVGTGGMRTKLIAADLASNAGIETIVMKSDRPEYVPKIVDYIQHHFRPPRHIGNGTQQQFLDLQDTELEQLRRYDVPMHTKFLANDNKHKLKNREFWILHGLITKGAIIIDENSYDKLLSKDMASLTPNAVIEVRDNFHELECVDLKIGQRLPNGELDISKPIQSVGCVRSNYTSLELAKIKGLPSEKIHDVLGYSVSEYVAHRENIAFPPQF

SEQ ID NO: 494 - DNA, 1137 bp, Rhizobium loti
  CDS (1)..(1137): transl_table=11
atgcagtcgctgaaaaaataccggcgcatcaccgtcaagatcggctcggcgctgctcgtcgaccgcgcgagcggcttgaagcgcgactggctggactcgctcgccgacgacatagcggtgcttgcccagggcggcgccgaaatcctcgtcgtctcctccggcgccatcgcgcttggccgcaccatccttggccttggcaagcgtgccttgaagctcgaggagagccaggcggccgccgccgtcgggcagatcgcgctcgccggcgcctggtcggatgcactcggcaggggcgccctgaagtcgggccagattcttctgacccttggcgataccgaagagcgccgccgctatctcaatgcgcgcgcgacgatctcgacattgctcaagatgaaggcggtgccggtcatcaacgagaacgacacggtcgccacctccgaaatccgctatggcgacaatgaccggctggccgcgcgcgtggccaccatgatgggcgccgatcttctggtgctgctctccgacatcgatgggctctacaccgcaccgccggcgcgcgaccccaaggccaagttcattccggtggtcgaccgcatcacgcccgacatcgaggcgatggcgggggctgccgcctccgaactgtcgcgcggcggcatgcgcaccaagctcgatgccggcaagatcgccaccgccgccggcaccgcgatgatcatcacctcgggcacgcggctgtcgccgctgatggcgatcgagcgcggcgagcgcgccaccttcttccggccgagcgccaatccggtcaagggctacaagacctggatcgccggccagctcgaaccggccggccggctgacggtcgacgccggcgccgtcggtgcgctcgcatcgggcaaatcgctgctgccggccggcgtcaaactggtcagcggcaatttttcgcgcggggatacggtggcgatcctgtcgcccgacgggcgcgagatcgcgcgcgggctggttgcctatgatgccgccgatgccgtaaggatcgcaggcctgaagacggccgagatcgaaaccgtgctcggctacgaagcgcgttcagcgatgatccaccgcgacgacctcgtggtgagtcacgctgggggcgacataagcggaggatga

SEQ ID NO: 495 - protein, 378 aa, Rhizobium loti
MQSLKKYRRITVKIGSALLVDRASGLKRDWLDSLADDIAVLAQGGAEILVVSSGAIALGRTILGLGKRALKLEESQAAAAVGQIALAGAWSDALGRGALKSGQILLTLGDTEERRRYLNARATISTLLKMKAVPVINENDTVATSEIRYGDNDRLAARVATMMGADLLVLLSDIDGLYTAPPARDPKAKFIPVVDRITPDIEAMAGAAASELSRGGMRTKLDAGKIATAAGTAMIITSGTRLSPLMAIERGERATFFRPSANPVKGYKTWIAGQLEPAGRLTVDAGAVGALASGKSLLPAGVKLVSGNFSRGDTVAILSPDGREIARGLVAYDAADAVRIAGLKTAEIETVLGYEARSAMIHRDDLVVSHAGGDISGG

SEQ ID NO: 496 - DNA, 1182 bp, Rhizobium meliloti
  CDS (1)..(1182): transl_table=11
atgaccaaggcccgcaaagcgctcgagaattaccgccgggtcgtcatcaagatcggctcggcactcctcgtcgaccgcaggaccgggctgaagaagagctggctcgacgcgctctgcgccgacattgcggccctcagggccaagggcgtggaagtgctcgtcgtctcctcgggagcgattgcgcttggacgcacggtgctcgacctgccggcgggtgcgctgaagctcgaagagagccaggcggccgccgccgtcggccagatcgtgctggcgcgtgcctggtcggagagcctctcgacccatgcgatcgtcgccggccagatcctcctgacgctgggcgacaccgaggagcgccggcgctacctcaatgcccgcgcgacgatcggtcagcttctgaagctcggctcggtgccgatcatcaacgagaacgacacggtcgcgaccacagaaatccgctatggcgacaacgaccggctggcagcgagggtcgcgaccatggtcggcgccgatctcctggtcctgctctcggatatcgacgggctctataccgcgccgccgcatctcgatccgaacgcccgtttcctcgaaacggtcgccgaaatcacgcccgaaatcgaggcgatggcgggcggcgctgcctccgagctttcgcgcggcggcatgcgcaccaagatcgacgccggcaagatcgcaaccactgccggctgcgcgatgatcatcgcctccggcaagccggatcatccgctggccgcgatcgaggcgggcgcgcgctcgtcctggttcgcgccatcaggctctccggtgaccgcccgcaagacctggatcgccggacagctcctgccggccggttcgctctcgatcgatgccggagcggaaacggcgctgcgttccggcaagagcctgctgccggccggcgtccggcaggtgacgggaagcttcagccgcggcgatacgattgcgataatcggcgcttccggccgcgagatcgcccgcggtcttgccggctacgatgccgacgaggcgcgccagatcgccggcaagaagtcggccgagatcgccgccatcctcggctatgccggccgcaccgccatggtgcatcgcgacgatctggtcatgacggctccatcgggcgcgcgccttgtagaggaaagcgacgagggaaagggcaagctccatgcttga

SEQ ID NO: 497 - protein, 393 aa, Rhizobium meliloti
MTKARKALENYRRVVIKIGSALLVDRRTGLKKSWLDALCADIAALRAKGVEVLVVSSGAIALGRTVLDLPAGALKLEESQAAAAVGQIVLARAWSESLSTHAIVAGQILLTLGDTEERRRYLNARATIGQLLKLGSVPIINENDTVATTEIRYGDNDRLAARVATMVGADLLVLLSDIDGLYTAPPHLDPNARFLETVAEITPEIEAMAGGAASELSRGGMRTKIDAGKIATTAGCAMIIASGKPDHPLAAIEAGARSSWFAPSGSPVTARKTWIAGQLLPAGSLSIDAGAETALRSGKSLLPAGVRQVTGSFSRGDTIAIIGASGREIARGLAGYDADEARQIAGKKSAEIAAILGYAGRTAMVHRDDLVMTAPSGARLVEESDEGKGKLHA

SEQ ID NO: 498 - DNA, 1170 bp, Agrobacterium tumefaciens
  CDS (1)..(1170): transl_table=11
atgagcctgacgcgcaagccgctggcgagccaccaccggatcgtcatcaagatcggttcggcgcttctggtggaccggaaaagcggcctgaagaaagactggctggatgccatctgcgaggatatcgcggcgctgaaaaaaaacggcgcggatgtccaggtcgtgtcttctggcgccattgcgcttggccgcaccgtgctcggcctgccttccggtgcactgaagctggaagaaagccaggcggcggcggcagtcggccagattgcgctggcgcgggcatggtcggaaagcctgtcgcggcatgagatcgtcgccggtcaaattctattgacgctatccgataccgaggagcgtcggcgttatctcaacgcgcgtgccaccatcaatcagcttttgaagatcggcgccattccgatcatcaatgaaaacgacacggtggcgaccactgaaatccgttatggggacaatgaccgtctggccgcgcgcgtggccacgatgacgggtgccgatctcctggtgctgttgtcggatattgacgggctctacaccgccccaccgcatctcgatcccgatgcgaaatttcttgagacgattgccgatatcacgcccgaaatcgaagccatggcgggtggggcggcctccgagctttcgcgcggcggtatgcgcaccaagatcgatgcgggcaagatcgcgaccgctgccggttgtggtatgatcatcgcttccggcaagacgctcaatccgctgaaggcaatcgaaaacggcgcacggtcttcatggtttgcaccctccggcacgccggtgacggcccgcaagacctggattgccgggcaattgcagccggccggcgaaatccatgtggatgccggggccgaaaaggcgctttatgctgggaaaagcctgcttcccgccggtgtgcggcaggtgaagggcaatttcggacgcggcgatgccattgccatcatcggcgtcgaaggccgtgaagtggcgcgcggtcttgcgggttacgatgcagaggaagcgcgcctgatcatcggccacaagtccaacgagatcgagacgatcctcggttatgtcggacgggcggcgatgatccatcgcgacgaccttgtgatgactggcgctgccgtcaaagtgaaacatgcaaagaaggatgaggtccatgcctga

SEQ ID NO: 499 - protein, 389 aa, Agrobacterium tumefaciens
MSLTRKPLASHHRIVIKIGSALLVDRKSGLKKDWLDAICEDIAALKKNGADVQVVSSGAIALGRTVLGLPSGALKLEESQAAAAVGQIALARAWSESLSRHEIVAGQILLTLSDTEERRRYLNARATINQLLKIGAIPIINENDTVATTEIRYGDNDRLAARVATMTGADLLVLLSDIDGLYTAPPHLDPDAKFLETIADITPEIEAMAGGAASELSRGGMRTKIDAGKIATAAGCGMIIASGKTLNPLKAIENGARSSWFAPSGTPVTARKTWIAGQLQPAGEIHVDAGAEKALYAGKSLLPAGVRQVKGNFGRGDAIAIIGVEGREVARGLAGYDAEEARLIIGHKSNEIETILGYVGRAAMIHRDDLVMTGAAVKVKHAKKDEVHA

SEQ ID NO: 500 - DNA, 1110 bp, Anabaena variabilis
  CDS (1)..(1110): transl_table=11
atgaccaaaacaattgtcgtcaaaatcggcacatctagcctcacccaaccagaaaccggacaactagccctctccaccattgcaactttggcggaaacactctcttatttaagacagcaaggtaatcaagtgattttagtctcctctggggctgtgggagtcggttgtgcgcggttgggtttaacggaacgtcccaaagcgatcgctctcaaacaagcagtagccgcagtgggtcaaggtagattaatgcgcgtatatgacgacttatttaccaccttacaacagccgatcgcccaagttttgctaactcgcagcgatttggtacaacgtagccgttatctcaacgtatacaacacctttcgggaattacttgccttgggggtaattcctgtagtcaacgagaatgataccgttgccgtggatgaactgaaatttggtgataatgataccctttcagctttggttgctagtcttgtagaggcagactggctatttttactcactgacgtagaccgattatactcagccgatccccgttctgtccccgatgcccgaccgatatctttggtgacaagcatcaaagaattagcagacttacaagtacaaacaggttctcaaggttctcaatggggtactgggggaatgatgacaaaaatttcggcggcgagaattgcgatcgcggcgggagtgcgtactgtgattactcaagggcgatatcctcgcaatatcgaaaaaattatccaaggggaactgattggaactcattttcaaccccaaccagaaccaacctccgcccgtaaacgttggattgcttacggtttagtcccgacaggtaaattatacttagattctggtgcgatcgccgccatagttaaagcaggtaaatcgttattgccagcaggagttaaaaccgttgcaggtgaatttgagcctcaagatgcagtacagctattagatcctcaaggtaacgaaattgccagaggactagttaactatagcagcaaagacttacagcaaatttgtggtcgtcactctaaagaaatttcgactattttgggttatgtaggtgcagaaaccgtgatccatcgagataacttagtattgacgtag

SEQ ID NO: 501 - protein, 369 aa, Anabaena variabilis
MTKTIVVKIGTSSLTQPETGQLALSTIATLAETLSYLRQQGNQVILVSSGAVGVGCARLGLTERPKAIALKQAVAAVGQGRLMRVYDDLFTTLQQPIAQVLLTRSDLVQRSRYLNVYNTFRELLALGVIPVVNENDTVAVDELKFGDNDTLSALVASLVEADWLFLLTDVDRLYSADPRSVPDARPISLVTSIKELADLQVQTGSQGSQWGTGGMMTKISAARIAIAAGVRTVITQGRYPRNIEKIIQGELIGTHFQPQPEPTSARKRWIAYGLVPTGKLYLDSGAIAAIVKAGKSLLPAGVKTVAGEFEPQDAVQLLDPQGNEIARGLVNYSSKDLQQICGRHSKEISTILGYVGAETVIHRDNLVLT

SEQ ID NO: 502 - DNA, 1116 bp, Azoarcus sp
  CDS (1)..(1116): transl_table=11
atgagagacaagatccgcaacgcgcgacgcatcgtcgtcaaagtcggcagcgcactcgtcacgaacaacggcgccggactcgacaaagcggcgatgggcgactgggcgcgccagatcgcaacgttgcgtggcgcgggcaagcaggtcgtgctggtgtcgtccggtgcgatcgccgcgggaatgcagcgcctcggctggcaaaagcgcccgcacgaaatgcacaagctgcaggccgccgccgcggtcgggcaaatgggcctcgtcaaagcctacgaggatgccttttcgcgtcacaatctccacaccgcgcagatcctgctgacccacgacgacctcgccgaccgcaagcgctacctcaacgcacgttcgacgctgacgacgctgctcgagctgggcgtcgtgccgatcatcaacgagaacgacacgatcgtcaccgacgagatcaagttcggcgacaacgacacgctcggcgcgctggtcgcgaacctcatcgaagctcatgcgctggtgatcctcaccgaccagcaaggcttgtacactgccgacccgcgccgcgaccccaatgcgacgctcgtctgcgaaggtcgggccgaggacaggtcgtacgaagcgatggcaggcggcgccggcaccggtatcagcaggggcggcatgatcacgaagatccgcgccgcccagcgtgcggcgcgaagcggggcgcacacgtgcatcgcgagcggcaacgaagtcgacgcgctgatccgcctcacgcaggccgaaccgctcggcaccctgctctacgcgaccagttcgccgctgcaggcgcgcaagcagtggctcgccgaccacctgcagctcgcgggcgacctcattctcgacgacggcgcggtcgttgcgttgcgcagcggacgcagcttgttgcccgtgggcgtcgtcgaggtcggaggcgaattcgagcgcggcgcagcggtcgcatgccgtagcgccggcggtgacgagatcgcacgcggcctagtcaactacagtagcagcgagtgccgccgcatcgcgcgcaaatccagcacacaaatcgaaaagctgctcggctacatcgacgaacccgaactggttcaccgcgacaacatggtactgcgataa

SEQ ID NO: 503 - protein, 371 aa, Azoarcus sp
MRDKIRNARRIVVKVGSALVTNNGAGLDKAAMGDWARQIATLRGAGKQVVLVSSGAIAAGMQRLGWQKRPHEMHKLQAAAAVGQMGLVKAYEDAFSRHNLHTAQILLTHDDLADRKRYLNARSTLTTLLELGVVPIINENDTIVTDEIKFGDNDTLGALVANLIEAHALVILTDQQGLYTADPRRDPNATLVCEGRAEDRSYEAMAGGAGTGISRGGMITKIRAAQRAARSGAHTCIASGNEVDALIRLTQAEPLGTLLYATSSPLQARKQWLADHLQLAGDLILDDGAVVALRSGRSLLPVGVVEVGGEFERGAAVACRSAGGDEIARGLVNYSSSECRRIARKSSTQIEKLLGYIDEPELVHRDNMVLR

SEQ ID NO: 504 - DNA, 1140 bp, Bartonella henselae
  CDS (1)..(1140): transl_table=11
atggcagttggattgcaaaagcttgtacattataaacgcattgtgatcaaaattggatctgcgcttttggttgatcctcagacaggtttacgcgctgaatggcttaaaagtttaataagtgatgttgccaacttgcatcaaaaaggcgttgagattttattggtttcttcaggggctattgctttaggaagaacattgcttcgtcttcctaagggggctttgaaattggaagagagtcaggcttgtgctgctttggggcaaattgagttggctaaaacctatagtgatacgcttgcgcaatatggattaaaaacgggtcagattttgctcactctcttcgatacggaagaacgacggcgttatctcaatgcgcgcgctacgattaatgtgcttttacgttttggagcggtacccgttattaatgaaaatgatactgttgccacaagtgaaattcgctatggtgataatgatcgtttagcagcacgtgtagcaacgatgatgggggcagatcttttgatacttttatcagatattgatggtctttataccaaatctccccatcgtgatccaacggcagagtttattccttttattgcatcaattacgagtgatatcgaaaaaatggcagatgttgctcattcagagctgtctcgtggaggaatgaagactaagcttgatgctggaaaaatagcaaattctgctggaacggctatgattattacttcagggaagcgtatgaatcctcttgcggcgattgacagaggggaacgcggaagtttttttgctgccggtgaaaagcctgttaatgcttggaaaacttggatttctggtcatttagatccctctggtattttaatgattgatcaaggagcggttaaggctcttgaatctggaaaatccttattagctgcgggagtcgtagcgattgagggaagattcaatcgtggagatacggttgcgattgttgatacaaatggcgttgaaattgctcgtggacttgtgagttatggcaaagatgaatctgtacgcattatggggcgtaaaagcgaagaaattgaatctatcctagggtatgaagcgcgttctgctatggtgcatcgtaatgatatggttttacgctgcttgaccgattctgcttaa

SEQ ID NO: 505 - protein, 379 aa, Bartonella henselae
MAVGLQKLVHYKRIVIKIGSALLVDPQTGLRAEWLKSLISDVANLHQKGVEILLVSSGAIALGRTLLRLPKGALKLEESQACAALGQIELAKTYSDTLAQYGLKTGQILLTLFDTEERRRYLNARATINVLLRFGAVPVINENDTVATSEIRYGDNDRLAARVATMMGADLLILLSDIDGLYTKSPHRDPTAEFIPFIASITSDIEKMADVAHSELSRGGMKTKLDAGKIANSAGTAMIITSGKRMNPLAAIDRGERGSFFAAGEKPVNAWKTWISGHLDPSGILMIDQGAVKALESGKSLLAAGVVAIEGRFNRGDTVAIVDTNGVEIARGLVSYGKDESVRIMGRKSEEIESILGYEARSAMVHRNDMVLRCLTDSA

SEQ ID NO: 506 - DNA, 1155 bp, Bartonella quintana
  CDS (1)..(1155): transl_table=11
atgtcaggactgattaagacagctggattgcaaaaacttgcgcactataaacgtattgtggtaaaaattggatctgcgcttttggttgagcctcagacaggtttacgagctgaatggcttaaaagtttgataaatgatgttgccaagttgcatcaaaaaggcgttgagattttattagtgtcttcaggggctattgccttagggagaacattgctccgtcttcctagaggtgctttgaaattggaagaaagtcaggcatgtgctgctttggggcaaattgaattagcaaaaacctatggtgatgcgcttgctcaatatggattaaaaactggtcagattttgctcactctattggatacggaagagcgacggcgttatctcaatgcgcgtgctacgattaatgtgcttttacgttttggagcagtgcctgttattaatgagaatgatactgttgcaacaagtgaaattcgttatggtgataatgatcgtttagcagctcgtgtggcgacgatgatgggtgcggatcttttaatacttttatcagatattgatggtctttatacgaagtctcctcatcgtgatccaacagctgaatttattccttttattgcatcaattacaagtgatatcgaaaaaatggcagacgttgctgcttcagagctttcacggggaggaatgaagactaagcttgatgccggaaaaatagcaaattctgctggaacagcaatggttattacttcaggcaagcgcatgaatcctcttgcagcgattgatagaggggaacgcagaagtttttttgctgccagtgaaaagcctgttaatgcttggaaaacatggatttctggtcatttaggtccgtctggtattttaacgattgatccgggagcagctaaggctcttgaatcgggaaaatctttattagctgcaggagttatagcggttgatgggatgtttcatcgtggagatacggttgcaattgttgatacaaatggcgttgagattgctcgtgggcttgtgagttatggcaaaaatgaagctgtacgcattatggggtgtaaaagagaagaaatcgagtctattcttgggtatgaagcgcgttctgctatggtgcatcgtaatgatatggttttacgctgcttgaccgattctacttaa

SEQ ID NO: 507 - protein, 384 aa, Bartonella quintana
MSGLIKTAGLQKLAHYKRIVVKIGSALLVEPQTGLRAEWLKSLINDVAKLHQKGVEILLVSSGAIALGRTLLRLPRGALKLEESQACAALGQIELAKTYGDALAQYGLKTGQILLTLLDTEERRRYLNARATINVLLRFGAVPVINENDTVATSEIRYGDNDRLAARVATMMGADLLILLSDIDGLYTKSPHRDPTAEFIPFIASITSDIEKMADVAASELSRGGMKTKLDAGKIANSAGTAMVITSGKRMNPLAAIDRGERRSFFAASEKPVNAWKTWISGHLGPSGILTIDPGAAKALESGKSLLAAGVIAVDGMFHRGDTVAIVDTNGVEIARGLVSYGKNEAVRIMGCKREEIESILGYEARSAMVHRNDMVLRCLTDST

SEQ ID NO: 508 - DNA, 1134 bp, Bifidobacterium longum
  CDS (1)..(1134): transl_table=11
atgagcactccgagtcaggccgaggtgcggcgcatgatcgccgcagccggaaccattgtcgtgaaagtcggctccagctcgctgacccagccgagcggtcacctcgacccggacaagctcgacgcgttggccgcggccttggctcaggtccgattgatgggcggacgtgtggtgctggtctcgtccggtgctatcgccgccggtttcgggcctctgggctttgactcgcggccggtggacgtggccactcagcaggccaccgcagccgtcggccaagggctactgatggcccgctacgagactgcgttcggtcgattcggtattcgcgtcggccagattctgatcactgccgaagatacgattcgtgccacccagtaccgcaatgtggaacgcacgctggaccgtctgcttgacctcggcgtggtgccgatcatcaacgaaaacgattcgttggcctcgaacgagattcgcttcggcgacaacgatcgactctccgcgttggtggccaacctggtgcgggccgaagccttggtgctactgaccgacgtggacgcgctgtacactgcgccgccctcgcagcccggctcccgccgtgtggaatatgtgcccaacgtgattgatgcgctgggcgacatccaagtctccggctccggctccaaggtcggcaccggcggcatggtcaccaaactcgaggccgcgcgcgtggcggccgtctcgggcatccccacggtactcacctgcgcctcgaacgcgggccctgcgatgatgggcgatccggtgggcaccgtgttcgcaccggttaaggcccgcggctcctcacgccgtctgtggatcggcttcgccgccgacccgcgcggcacgattgtggtcgatgcgggtgccggccaggcgattcgcggcgggcgtgcctcgctgctggcggccggcgcgctcgaagtacatggcgatttttccgccggcgatccggtctggatcgatgccgaaagcggtgaacacctggcccgaggcctcgccggcttcgattccgaagaaattccgcagatgctcgggcgtaacaccgcccaactcaagcgtttcctcggcccccagtacgcccacccactggttcatcgcgacaatctcgtgctcgtgtga

SEQ ID NO: 509 - protein, 377 aa, Bifidobacterium longum
MSTPSQAEVRRMIAAAGTIVVKVGSSSLTQPSGHLDPDKLDALAAALAQVRLMGGRVVLVSSGAIAAGFGPLGFDSRPVDVATQQATAAVGQGLLMARYETAFGRFGIRVGQILITAEDTIRATQYRNVERTLDRLLDLGVVPIINENDSLASNEIRFGDNDRLSALVANLVRAEALVLLTDVDALYTAPPSQPGSRRVEYVPNVIDALGDIQVSGSGSKVGTGGMVTKLEAARVAAVSGIPTVLTCASNAGPAMMGDPVGTVFAPVKARGSSRRLWIGFAADPRGTIVVDAGAGQAIRGGRASLLAAGALEVHGDFSAGDPVWIDAESGEHLARGLAGFDSEEIPQMLGRNTAQLKRFLGPQYAHPLVHRDNLVLV

SEQ ID NO: 510 - DNA, 1137 bp, Bordetella bronchiseptica
  CDS (1)..(1137): transl_table=11
atgactgcccaaacctctgccgtttctgtcatttccgcggccaatcggctggtcgccaaagtgggttcctcgctggtcaccaacgaaggccggggcctcgatcgcgccgcggtaggccactgggcagcccagatcgccgccctgcaccagcagggcaagcaggtcgtgctggtttccagcggcgccattgccgaaggcatggcgcggctgggctggcgcaagcgcccttcggccatgcacgaattgcaggccgccgccgccgtgggccagatgggcctgtgccaggcttacgaagccgccttcgccgagttcggcctgcgcaccgcgcagatcctgctcacccacgaagacctggccgaccggcaccgctacctgaatgcgcgctcgaccctgttcgccctgctgcgcctgggcgtggtgcccatcgtcaacgaaaacgacaccgtcgtcaccgacgaaatccgcttcggcgacaatgacaccctgggcgccctggtcaccaacctgatcgaagccgatgcgctcatcatcctgaccgaccagcgcggcctgtacgaagccgacccgcgccgcgacccggccgcgcgcttcgtggcgcatgcgcaagccggcgatgccgccctggaagccatggccggcggcgccggcagcggcgtgggcaccggcggcatgctcaccaagatcctggcggccaagcgggccgcccacagcggcgcccataccgtcatcgcatcaggccgcgaacgcaatgtgctgacccgcctggcgcaaggcgaatgcatcggcacggaattgcgcgcggtcctgccggtatggtcggcgcgcaagcaatggctggccgaccacctgcgcctgcgcggccgcgtggtgctcgatgatggcgccgtgcatgccctgctgcacgagggcaagagcctgctgcccatcggcgtggccgaagtccagggcgagttcgagcgcggcgacgtcgtggcctgcgtcgacatgcatggacgcgagtgcgcgcgcggcctgatcaattattcgtcggccgatacccggcgcatcctgcgccagccgtcgagccagatcgcgcgcatcctgggcagcatgacagacccggaactgatgcaccgcgacaacctggtcgtcacctga

SEQ ID NO: 511 - protein, 378 aa, Bordetella bronchiseptica
MTAQTSAVSVISAANRLVAKVGSSLVTNEGRGLDRAAVGHWAAQIAALHQQGKQVVLVSSGAIAEGMARLGWRKRPSAMHELQAAAAVGQMGLCQAYEAAFAEFGLRTAQILLTHEDLADRHRYLNARSTLFALLRLGVVPIVNENDTVVTDEIRFGDNDTLGALVTNLIEADALIILTDQRGLYEADPRRDPAARFVAHAQAGDAALEAMAGGAGSGVGTGGMLTKILAAKRAAHSGAHTVIASGRERNVLTRLAQGECIGTELRAVLPVWSARKQWLADHLRLRGRVVLDDGAVHALLHEGKSLLPIGVAEVQGEFERGDVVACVDMHGRECARGLINYSSADTRRILRQPSSQIARILGSMTDPELMHRDNLVVT

SEQ ID NO: 512 - DNA, 1137 bp, Bordetella parapertussis
  CDS (1)..(1137): transl_table=11
atgactgcccaaacctctgccgtttctgtcatttccgcggccaatcggctggtcgccaaagtgggttcctcgctggtcaccaacgaaggccggggcctcgatcgcgccgcggtagaccactgggcagcccagatcgccgccctgcaccaacagggcaagcaggtcgtgctggtttccagcggcgccattgccgaaggcatggcgcggctgggctggcgcaagcgcccttcggccatgcacgaattgcaggccgccgccgccgtgggccagatgggcctgtgccaggcttacgaagccgccttcgccgagttcggcctgcgcaccgcgcagatcctgctcacccacgaagacctggccgaccggcaccgctacctgaatgcgcgctcgaccctgttcgccctgctgcgcctgggcgtggtgcccatcgtcaacgaaaacgacaccgtcgtcaccgacgaaatccgcttcggcgacaacgacaccctgggcgccctggtcaccaacctgatcgaagccgatgcgctcatcatcctgaccgaccagcgcggcctgtacgaagccgacccgcgctgcgacccggccgcgcgcttcgtggcgcatgcgcaagccggcgatgccgccctggaagccatggccggcggcgccggcagcggcgtgggcaccggcggcatgctcaccaagatcctggcggccaagcgggccgcccacagcggcgcccataccgtcatcgcatcaggccgcgaacgcaatgtgctgacccgcctggcgcaaggcgaatgcatcggcacggaattgcgcgcggtcctgccggtatggtcggcgcgcaagcaatggctggccgaccacctgcgcctgcgcggccgcgtggtgctcgatgatggcgccgtgcatgccctgctgcacgagggcaagagcctgctgcccatcggcgtggccgaagtccagggcgagttcgagcgcggcgacgtcgtggcctgcgtcgacatgcatggacgcgagtgcgcgcgcggcctgatcaattattcgtcggccgatacccggcgcatcctgcgccagccgtcgagccagatcgcgcgcatcctgggcagcatgacagacccggaactgatgcaccgcgacaacctggtcgtcacctga

SEQ ID NO: 513 - protein, 378 aa, Bordetella parapertussis
MTAQTSAVSVISAANRLVAKVGSSLVTNEGRGLDRAAVDHWAAQIAALHQQGKQVVLVSSGAIAEGMARLGWRKRPSAMHELQAAAAVGQMGLCQAYEAAFAEFGLRTAQILLTHEDLADRHRYLNARSTLFALLRLGVVPIVNENDTVVTDEIRFGDNDTLGALVTNLIEADALIILTDQRGLYEADPRCDPAARFVAHAQAGDAALEAMAGGAGSGVGTGGMLTKILAAKRAAHSGAHTVIASGRERNVLTRLAQGECIGTELRAVLPVWSARKQWLADHLRLRGRVVLDDGAVHALLHEGKSLLPIGVAEVQGEFERGDVVACVDMHGRECARGLINYSSADTRRILRQPSSQIARILGSMTDPELMHRDNLVVT

SEQ ID NO: 514 - DNA, 1122 bp, Bradyrhizobium japonicum
  CDS (1)..(1122): transl_table=11
atggccagccccgaactcagtcaattccgccgcatcgtcgtcaaggtcggctccgcactgctggtcgattccgacaagggcgaggtgcggacgtcctggctcgccgcgcttgccgacgacatggccaagctgcacaaggagggacgcgacgtcctcgtcgtctcctcgggctcgatcgcgctcggccgcagccggctcaagctgccgcgcggcccgctgaagctggaggagagccaggccgccgctgccgtcggccagatcgcgctggcgcggatctggtccgaggtgctcggcgcgcacggcatcgacgccgggcagattctcgtgacgctccaggataccgaggagcgccgccgctatctcaatgcgcgctccaccatcggcaagctcctggagtggcgcgccatccccgtgatcaacgagaacgacacggtcgccaccaccgagatccgctacggggacaacgaccgcctcgccgcgcgcgtcgcgaccatggcgagcgccgatctcctggtgctgctctccgatatcgacgggctctacgatgcccccccgaagaacaacccgaacgcaaagctcattcccgtcgtcgacagcatctcctcggagatcgaggctgtcgcaggcgacgccgagtccgagctctcgcgcggcggcatgcgcacgaaggtcgaggcggccaagatcgccacgaccggcggcacgcatatgctgatcgcctccggcaagatcgagcatccgctgcaggcaatcgccaatggcggccgctgcacctggttcctgacaccggccaatcccatcacctcgcgcaagcgctggatcgcgggcacgctggagccgaagggcacgctgacgatcgacgccggcgcggtgacggcgctgcgggccggcgccagcctgctgccggccggcgtgatcaaggtcgagggccagttcgcccgcggcgatgccgtgatcgtgcgcggccccgatacgagcgagatcggccgcggcctgatcgcctatgacgccgacgacgccgaacgcatcaagggccgctcctcccctgatgtgatgaccatcctcggcatcagcggccgcgcggagatgatccaccgtgacgatctggtggtgggcgggtaa

SEQ ID NO: 515 - protein, 373 aa, Bradyrhizobium japonicum
MASPELSQFRRIVVKVGSALLVDSDKGEVRTSWLAALADDMAKLHKEGRDVLVVSSGSIALGRSRLKLPRGPLKLEESQAAAAVGQIALARIWSEVLGAHGIDAGQILVTLQDTEERRRYLNARSTIGKLLEWRAIPVINENDTVATTEIRYGDNDRLAARVATMASADLLVLLSDIDGLYDAPPKNNPNAKLIPVVDSISSEIEAVAGDAESELSRGGMRTKVEAAKIATTGGTHMLIASGKIEHPLQAIANGGRCTWFLTPANPITSRKRWIAGTLEPKGTLTIDAGAVTALRAGASLLPAGVIKVEGQFARGDAVIVRGPDTSEIGRGLIAYDADDAERIKGRSSPDVMTILGISGRAEMIHRDDLVVGG

SEQ ID NO: 516 - DNA, 1137 bp, Brucella melitensis
  CDS (1)..(1137): transl_table=11
atgctgaagaaactgaaagactatcgccgcatcgttgttaaaataggctctgcccttctggtggaccgggccacaggcctgaagcgcgaatggctggaaagcctggggcaggatattgccgccttgcagcatgcgggcgttgaggtgctggtggtttcgtcgggtgcaattgcactggggcgcacggttctgggcctgccgaaaaaggcgctgaagcttgaggaaagccaggcggcggcagcagccgggcagattgcgctggcgaaggcttatgcggatgtgctgggcggacatggcatcaagtcgggacagattctggtcacgctttccgatacggaagagcgccgccgctatctcaatgcgcgcgcaaccatcgagaccctgctgaagctcaaggccgtgccgatcatcaatgaaaacgatacggtggcaaccaccgaaatccgttatggcgacaatgacaggttggcggcgcgcgtcgcgaccatgatgggcgcggaccttctgatcctgctttccgacattgacgggctttataccgcgccgccgcacaagaatccggatgcgcaatttctgccctttgtcgaaaccatcacgccgcagatcgaagccatggcgggggcggcagcatccgagctttcgcggggtggcatgaagaccaagctcgatgcgggcaagattgcaaacgctgccgggaccgcgatgattatcacttcgggcacgcgtttcggcccgctttcggcaattgaccgaggggagcgtgcgacattgttcgaggctgcccatgcgccggtcaatgcgtggaagacgtggatttccggcaatctggaaccggctggccggttgactgtggatgcgggtgctgtcaaggcgctcaaatccggcaaatcgcttttgcctgcgggcgtgaaggaagttgacggggatttcgagcgtggcgacacggttgccgtcatgaacgaggatgggcgggagattgcgcgcggtctgatcgcctatgatgctgctgacgcccgcaaggttgccgggcataaaagcgatgagatcagtgccattcttggctatgatgcccgcgcggcgatgatccatcgcaacgatctggtggtgcgggccgccagcgatgcgaaagccgcatag

SEQ ID NO: 517 - protein, 378 aa, Brucella melitensis
MLKKLKDYRRIVVKIGSALLVDRATGLKREWLESLGQDIAALQHAGVEVLVVSSGAIALGRTVLGLPKKALKLEESQAAAAAGQIALAKAYADVLGGHGIKSGQILVTLSDTEERRRYLNARATIETLLKLKAVPIINENDTVATTEIRYGDNDRLAARVATMMGADLLILLSDIDGLYTAPPHKNPDAQFLPFVETITPQIEAMAGAAASELSRGGMKTKLDAGKIANAAGTAMIITSGTRFGPLSAIDRGERATLFEAAHAPVNAWKTWISGNLEPAGRLTVDAGAVKALKSGKSLLPAGVKEVDGDFERGDTVAVMNEDGREIARGLIAYDAADARKVAGHKSDEISAILGYDARAAMIHRNDLVVRAASDAKAA

SEQ ID NO: 518 - DNA, 1119 bp, Burkholderia mallei
  CDS (1)..(1119): transl_table=11
atgcgttcgatcatcgccgattcgaagcgcctggtagtgaaagtgggctcgagcctcgtcaccaacgacggccgcgggctcgatcatgacgccatcggccgatgggccgctcagatcgccgcgctgcgcggcgcgggcaaggaagtggtgctcgtcagctcgggcgcgatcgcggaaggcatgcagcgcctcggttggagcaagcggccgcgcgagatcgacgagttgcaagcggccgcggccgtcgggcaaatggggctcgcgcaggtatacgagagccggtttgccgaacacgggatccgcaccgcgcagattctcctcacgcatgcggatctcgccgaccgcgaacgctacctgaacgcgcgctcgacgctcctcacgctgctgcggctcggcgtcgtgccgatcatcaacgagaacgacaccgtcgtcaccgacgaaatcaagttcggcgacaacgacacgctcggcgcgctcgtcgcgaatctgatcgaaggcgatacgctcgtcatcctgaccgaccagccggggctgttcacggccgatccgcgcaaggatccgggcgcgacgctcgttgccgaggcgagcgccggtgcgccggagctcgaagcgatggcgggcggtgcgggctcgagcatcggccgcggcggcatgctgacgaagattctcgcagccaagcgcgccgcgcacagcggcgcgaacaccgtgatcgcgagcggccgcgagcgcgacgtgctcgtgcggctcgcggccggcgaggcgatcggcacgcaactgatcgcgcgcaccgcgcggatggcggcgcgcaagcaatggatggcggaccacctgcaggtacgtggccatgtcgttatcgatgcgggggcggtcgacaagttgacggcggggggcaagagcctgttgccgatcggcgtcgtcgccgtgcagggcgtgttcgcgcgcggcgaagtgatcgcgtgcgtcgacgacaccggccgtgaagtcgcgcgcgggatcaccaattacagcagcgccgaaacgaagctgatccagcgcaagccgagcggcgagatcgaaacggtgctcggctacatgctcgagcccgagctgatccatcgggacaatctcgtgctggtctga

SEQ ID NO: 519 - protein, 372 aa, Burkholderia mallei
MRSIIADSKRLVVKVGSSLVTNDGRGLDHDAIGRWAAQIAALRGAGKEVVLVSSGAIAEGMQRLGWSKRPREIDELQAAAAVGQMGLAQVYESRFAEHGIRTAQILLTHADLADRERYLNARSTLLTLLRLGVVPIINENDTVVTDEIKFGDNDTLGALVANLIEGDTLVILTDQPGLFTADPRKDPGATLVAEASAGAPELEAMAGGAGSSIGRGGMLTKILAAKRAAHSGANTVIASGRERDVLVRLAAGEAIGTQLIARTARMAARKQWMADHLQVRGHVVIDAGAVDKLTAGGKSLLPIGVVAVQGVFARGEVIACVDDTGREVARGITNYSSAETKLIQRKPSGEIETVLGYMLEPELIHRDNLVLV

SEQ ID NO: 520 - DNA, 1119 bp, Burkholderia sp
  CDS (1)..(1119): transl_table=11
atgcgttcgatcatcgcggattcgaagcgattggtggtgaaggtgggctccagcctcgtgaccaacgacggcaaggggctcgatcatgcagcaatcggccgttgggcggctcagatcgccgcactgcgcgcccagggcaaggaagtcgtgctcgtcagttcgggcgcgattgccgaagggatgcagcggctaggctggagcaagcggccgcgggaaatcgacgagttgcaggctgccgccgcagtcggccagatggggctcgcgcaggtctatgagagccgcttcaccgagcacgacatccgcaccgcgcagatcctgctgacgcatgccgacctggcggaccgcgagcgttacctgaatgcacgttcgacgatgctgacgctgttgcggctcggcgtcgtgccgatcatcaacgagaacgacacggtcgtcaccgacgaaatcaagttcggcgacaacgacacgctcggcgcgctcgttgcaaacctgatcgaaggcgatgcactgatcatcctgaccgaccagtcggggctgttcaccgccgatccgcgcaaggatccgaatgcgacgctcgttgcagaagccaatgcaggcgcgccggaactcgaggcgatggccggcggcgcgggttcgagcctcggccgcggcgggatgctgacgaagatcctcgcggcgaagcgcgcggcacacagcggcgcgaacaccgtgatcgcgagcggccgggagaccgacgtgctcgtgcgtctggcggccggcgaggcgatcggcacgcaactgatcgcacgtaccgcgcggatggcggcgcgcaagcagtggatggccgaccaccttcaggtgcgcggccatgtcgtgatcgacgcgggcgcggtcgagaagctgacggccggcggcaagagcctgctgccgatcggcgtgatcgacgtgcagggtgcgttcgcgcgcggtgaagtcatcgcgtgtgttggccccgacgggcgcgaagtggcgcgtgggctcacgaactacagcagtgcggagacgaaactgattcaccgcaaaccgagcggcgagatcgaatccgtgctcggctacatgctggagcccgagttgatccatcgcgacaacctggtgctggtgtga

SEQ ID NO: 521 - protein, 372 aa, Burkholderia sp
MRSIIADSKRLVVKVGSSLVTNDGKGLDHAAIGRWAAQIAALRAQGKEVVLVSSGAIAEGMQRLGWSKRPREIDELQAAAAVGQMGLAQVYESRFTEHDIRTAQILLTHADLADRERYLNARSTMLTLLRLGVVPIINENDTVVTDEIKFGDNDTLGALVANLIEGDALIILTDQSGLFTADPRKDPNATLVAEANAGAPELEAMAGGAGSSLGRGGMLTKILAAKRAAHSGANTVIASGRETDVLVRLAAGEAIGTQLIARTARMAARKQWMADHLQVRGHVVIDAGAVEKLTAGGKSLLPIGVIDVQGAFARGEVIACVGPDGREVARGLTNYSSAETKLIHRKPSGEIESVLGYMLEPELIHRDNLVLV

SEQ ID NO: 522 - DNA, 1119 bp, Burkholderia thailandensis
  CDS (1)..(1119): transl_table=11
atgcgttcgatcatcgccgattcgaagcgcttggtagtgaaagtcggctcgagcctcgtcaccaacgatggccgcgggctcgatcatgacgccatcggccgatgggctgcccagatcgccgcgctgcgcaacgagggcaaggaagtggtgcttgtcagctcgggggcgatcgcggaaggaatgcagcgcctgggctggagcaggcggccgcgcgagatcgacgagctgcaggctgccgcggcggtcgggcaaatggggctcgcgcaggtgtatgaaagccgttttgccgagcacggaatccgcaccgcgcagattctcctcacgcacgccgatcttgctgaccgcgaacgctacctgaacgcgcgctcgacgcttctcacgctgctgcggctcggcgtcgtgccgatcatcaacgagaacgacaccgtcgtcaccgacgaaatcaagttcggcgacaacgacacgctaggcgcgctcgtcgcgaacctgatcgaaggtgacgcgctcattatcctgaccgatcagcaggggcttttcacggccgatccgcgcaaggacccgggcgcgacgctcgttgccgaggcaagcgccggggcgccggagctcgaagcgatggcgggcggcgcgggctcgagcatcggccgcggcggcatgctgacgaagattctcgcggcgaagcgcgctgcgcacagcggcgcgaacacggtgatcgcgagcggtcgcgagcgcgacgtgctcttgcggctcgcgtccggcgaggcgatcggcacgcaactgatcgcgcgtaccgctcggatggcggcgcgcaagcagtggatggcggatcacctgcaggtgcgcggccacgtcgttatcgatgcgggcgcggtcgacaagctgacggcaggcggcaagagcctgttgccgatcggcgtcgtcgccgtgcagggcgtgttcgcgcgtggcgaagtgattgcgtgcgtcaatgatgcaggccgcgaagtcgcgcgcgggatcaccaattacagcagcgccgaagcgaagctgatccagcgcaagccgagcggcgaaatcgaagcggtgctcggctacatgctcgagcctgaactgatccatcgggacaatctcgtgctcgtctga

SEQ ID NO: 523 - protein, 372 aa, Burkholderia thailandensis
MRSIIADSKRLVVKVGSSLVTNDGRGLDHDAIGRWAAQIAALRNEGKEVVLVSSGAIAEGMQRLGWSRRPREIDELQAAAAVGQMGLAQVYESRFAEHGIRTAQILLTHADLADRERYLNARSTLLTLLRLGVVPIINENDTVVTDEIKFGDNDTLGALVANLIEGDALIILTDQQGLFTADPRKDPGATLVAEASAGAPELEAMAGGAGSSIGRGGMLTKILAAKRAAHSGANTVIASGRERDVLLRLASGEAIGTQLIARTARMAARKQWMADHLQVRGHVVIDAGAVDKLTAGGKSLLPIGVVAVQGVFARGEVIACVNDAGREVARGITNYSSAEAKLIQRKPSGEIEAVLGYMLEPELIHRDNLVLV

SEQ ID NO: 524 - DNA, 1119 bp, Burkholderia xenovorans
  CDS (1)..(1119): transl_table=11
atgcgttccgtcatcgcagattcacggcgattggtagtgaaagtgggttcgagcctcgtcacgaatgacgggcgcggcctcgatcatgccgctatcggccgctgggccggacagattgccgcgctgcgcgcgcaaggcaaggaggtggtgctcgtgagttcgggcgccatcgccgaagggatgcaacggctcggctggaccaggcggcctcgcgaaatcgacgaactgcaggcggccgcggccgttggccagatgggtctcgcacaggtctacgaaagccgctttgccgagcattccattcagaccgcgcagattctgctgactcacgccgaccttgccgaccgcgaacgctatctgaatgcgcgctccacgctgctcacgctgttgcgcctgggcgtggtgccgatcatcaacgagaacgacacggtcgttaccgacgaaatcaaattcggcgacaacgacacgttgggcgcactcgtcgcgaacctgatcgagggggacgcactcgtcatcctcaccgatcagcaagggctctttaccgccgacccgcgcaaggatccggccgccaccctcgtccagcaggccgatgccggcgcgccggaactggaagcaatggcgggcggcgcgggttcgagcctcgggcgcgggggcatgctgaccaagattctggccgccaagcgtgcggctcacagcggcgcgaatacggtgatcgcgagcgggcgcgaagtggacgtgctgtcgcggctcgcttcgggcgaggcgatcggcacgcagttgatcgcacgcacggcacggatggcggcgcgcaagcaatggatggcggatcatctgcaggtgcgtggtcacgtggtgatcgacgacggcgcagtcgaaaaactcaccgaaggcggcaagagcctgctgcccattggtatcgtcggcgttcagggcgcgtttgcgcgcggtgaggtgattgcctgtctgagcgccgcggggcgagaagtggcgcgcggactgaccaactacagcagcgctgaaaccaagctgatccagcggcggccgagtggcgaaatcgaatcggtgcttggctacatgctggagcctgagttgattcaccgcgacaacctggtgctggtctga

SEQ ID NO: 525 - protein, 372 aa, Burkholderia xenovorans
MRSVIADSRRLVVKVGSSLVTNDGRGLDHAAIGRWAGQIAALRAQGKEVVLVSSGAIAEGMQRLGWTRRPREIDELQAAAAVGQMGLAQVYESRFAEHSIQTAQILLTHADLADRERYLNARSTLLTLLRLGVVPIINENDTVVTDEIKFGDNDTLGALVANLIEGDALVILTDQQGLFTADPRKDPAATLVQQADAGAPELEAMAGGAGSSLGRGGMLTKILAAKRAAHSGANTVIASGREVDVLSRLASGEAIGTQLIARTARMAARKQWMADHLQVRGHVVIDDGAVEKLTEGGKSLLPIGIVGVQGAFARGEVIACLSAAGREVARGLTNYSSAETKLIQRRPSGEIESVLGYMLEPELIHRDNLVLV

SEQ ID NO: 526 - DNA, 1119 bp, Carboxydothermus hydrogenoformans
  CDS (1)..(1119): transl_table=11
atgcgcgaaatattaaaaaatgtccgccggctggttgtaaaaatcggttcttcgtccttaacccaccccgagacggggaaaattaaccttgcggctatggagcgttttgtaagggaatgtgccgatttaaaaaatgcaggattcgaagtaattattgtctcttccggagcaatagctgccggaatgggaaggcttgcccttccagaaaagccgaaaaatttaccggaaaaacaagcatgtgctgcggtaggccagggggtattaatgcatttatacgaaaaatttttttccgaataccaggtgatcgcagcgcaggtgcttttaaccggggaagatttggcggtaaggaagcgttttttgaacgccaaacatactttttcggcccttttaaattacggggttgttccggtggttaatgaaaacgatacggtagcggtagaggaaattcgctttggggataacgatacattatcggcccgggtagcggtactggtggaggctgatctcctggttcttctttccgatatcgatggcttgtataccgcagaccccaggaagaatagtaatgcccgttttcttccggaggttttggaaattaatgaggaaatcgaacagctggccgggggaagcgggacggcagttggtaccggtgggatggagaccaaaatagaggcggcgaaaatagcggtaaatgcggggatacccatggtaattgcccgggcagattatggcaatttgcggcgaattttaagaggggaagaggttggaacctttttttacccgaaaaagaaaaagcagtggaaaaagcaatggctgttatccggggcaagagtgcagggaagtatcatagttgatttgggagctgaagaagccctttgcagtggcggaaagagccttttgccttcgggagtgctgggagtggaaggagaatttccgacaggagctatagttgcggttaaaaatttaaagggacgggtgattgctaaagggcttaccaattatgcggctcaggatatcttaaaaattaagggacttcattcctgggaaattgctgacgttttaggccataaagattatgacgaaattattcaccgggataatctggtgctggtggattaa

SEQ ID NO: 527 - protein, 372 aa, Carboxydothermus hydrogenoformans
MREILKNVRRLVVKIGSSSLTHPETGKINLAAMERFVRECADLKNAGFEVIIVSSGAIAAGMGRLALPEKPKNLPEKQACAAVGQGVLMHLYEKFFSEYQVIAAQVLLTGEDLAVRKRFLNAKHTFSALLNYGVVPVVNENDTVAVEEIRFGDNDTLSARVAVLVEADLLVLLSDIDGLYTADPRKNSNARFLPEVLEINEEIEQLAGGSGTAVGTGGMETKIEAAKIAVNAGIPMVIARADYGNLRRILRGEEVGTFFYPKKKKQWKKQWLLSGARVQGSIIVDLGAEEALCSGGKSLLPSGVLGVEGEFPTGAIVAVKNLKGRVIAKGLTNYAAQDILKIKGLHSWEIADVLGHKDYDEIIHRDNLVLVD

SEQ ID NO: 528 - DNA, 1134 bp, Caulobacter crescentus
  CDS (1)..(1134): transl_table=11
gtgacgtcgggctcccagggagccttcgaggccgcccgccgcatcgtgttcaaggtcggctcggccctgctggtcgacgccgagacgggcgcagccaaccgcgcctggctggaggcgttctgcgccgacgccgccgacctgcgcgccgccggcaaacaggtgctcgtggtctcgtccggtgcggtggccctgggccgtcgtcggcttgggctgaccggtcgaaagaccaccctgcccgaaaagcaggccgccgccgccgcaggtcagagcctcctgatgcgcgcctgggaagaagctttcgagccgcacgggatcggcgtcgcccagatcctgctgacccgcgacgacaccgagatgcgccgccgctggctgaacgcccgcgcgacgaccgagaccttgatgggtttgggcgtcgtccccgtggtcaacgagaacgacaccgtcgtgaccgaggagatccggtacggcgacaacgaccgtctggccgcccgcgtcgcccagatggccggcgccgacctcctggtgctgctgtcggacatcgacggcctctacaccgccgacccgcgcaagaaccccaaggcccagcatatcccgcgggtctccgagatcacgccggagatcgccggcatggccgagggggccaacgccgccgccggcgtcggcaccggcggcatggccaccaaaatcgccgccgcccgtatcgcccgcgccgccggctgcgccaccctgatcaccctgggctcgcgcccccgcccgctggccgccatcgcagccggcgaaaaggccaccctgatcgaggcgggagcctcgcccgccgccgcctacaaggcctggatcgccggctcgctggcgccccagggctgggtcacggtcgacgccggggcggccagcgcgctgctggccggcaagagcctgctgcccgccggggtccgcgccgtcgagggtccgttcgacaagggcgacgccgtccgcgttcgcgacgaaaacggccgtgaggtcgcgcggggcctcgtgcgctatgacagcgccgacgcccagcggatcgcgggcctgagatcagacgccatcgaggccgaactcggctttaccgagggtccgatgatccatgccgacgacctggccgtagcccactag

SEQ ID NO: 529 - protein, 377 aa, Caulobacter crescentus
MTSGSQGAFEAARRIVFKVGSALLVDAETGAANRAWLEAFCADAADLRAAGKQVLVVSSGAVALGRRRLGLTGRKTTLPEKQAAAAAGQSLLMRAWEEAFEPHGIGVAQILLTRDDTEMRRRWLNARATTETLMGLGVVPVVNENDTVVTEEIRYGDNDRLAARVAQMAGADLLVLLSDIDGLYTADPRKNPKAQHIPRVSEITPEIAGMAEGANAAAGVGTGGMATKIAAARIARAAGCATLITLGSRPRPLAAIAAGEKATLIEAGASPAAAYKAWIAGSLAPQGWVTVDAGAASALLAGKSLLPAGVRAVEGPFDKGDAVRVRDENGREVARGLVRYDSADAQRIAGLRSDAIEAELGFTEGPMIHADDLAVAH

SEQ ID NO: 530 - DNA, 1119 bp, Chromobacterium violaceum
  CDS (1)..(1119): transl_table=11
atgcactcggtgattcacgcttcagaccgcatcgtggtcaaggtaggctccagcctggtaaccaacgacggcagggggctggacctgaacgcgctggcgcgctgggcggaggaagttgccgaactgaaacgccgcggcaagcaggtggtgctggtctccagcggcgccatcgccgaaggctgccagcgcctgggctggacggtgcgcccgaagggcgtgcatgagctgcaggccgcagccgccgtcggccagatgggcctgtgccaggcctacgagagcgcgttccgctccttcggcctgcgcaccgcgcagatcctgctgacccacgaagacctggccgaccgcacccgctacctgaacgcccgctccacgctgaccagcctgctgaatctgaacgtggtgcccatcatcaacgagaatgacaccgtggccaccagcgaaatccgcttcggcgacaacgacacgctgggcgcgctggtgaccaacctgatcgaagccgacgccctggtgatcctgaccgaccagcgcggactctacagcgccgacccgcgcaagcatcccgacgccgagttcatccaccaggccgaagccggcgacgagcgcctggaggacatggccggcggcgccggttccagcgtcggcaccggcggcatgatcaccaagatcctggccgccaagcgcgccgcccgcagcggcgccgccaccgtgatcgccagcggccgcgaaccccatgtgctgtctcggctggccgacggcgaagccatcggcacccagctggtcgccgccaccaaccgcatggccgcccgcaagcagtggctggccgaccacctgaagctggccggccgcctgctgctggacgacggcgccgcgctggcgatacgcgagcgcggcaccagcctgctgccggtgggcgtcagcgcggtggaaggcgatttcctgcgcggcgaggcggtggcctgcgtcgacgcggcggggcacgaggtggcgcgcggcctggtcaactacagctcggacgaagcgcgtcagatcatgcgcaaaagcacgcgcgagatcgaagccgcgctcggttacatcgtagaaccggagttgatccaccgggacaatatggtcgcgctctga

SEQ ID NO: 531 - protein, 372 aa, Chromobacterium violaceum
MHSVIHASDRIVVKVGSSLVTNDGRGLDLNALARWAEEVAELKRRGKQVVLVSSGAIAEGCQRLGWTVRPKGVHELQAAAAVGQMGLCQAYESAFRSFGLRTAQILLTHEDLADRTRYLNARSTLTSLLNLNVVPIINENDTVATSEIRFGDNDTLGALVTNLIEADALVILTDQRGLYSADPRKHPDAEFIHQAEAGDERLEDMAGGAGSSVGTGGMITKILAAKRAARSGAATVIASGREPHVLSRLADGEAIGTQLVAATNRMAARKQWLADHLKLAGRLLLDDGAALAIRERGTSLLPVGVSAVEGDFLRGEAVACVDAAGHEVARGLVNYSSDEARQIMRKSTREIEAALGYIVEPELIHRDNMVAL

SEQ ID NO: 532 - DNA, 1119 bp, Dechloromonas aromatica
  CDS (1)..(1119): transl_table=11
atgaatcccacccgcctcgccaacgccaagcgcctggtcgtcaaagtcggctcggcgctcgtcaccaacaacggcaccggccttgacctctcagccatcaacgactgggcgcgacagatcgccgtcctgcgccagcaagacaaggaagtcgtactcgtctcctccggcgccatcgcctgcggcatgcagcgcctgggctgggccaaacgaccgaagagcgtgcacgaactccaggcggccgctgccgttggccagatgggcctcgtccaggtctatgaaggcgccttcgccaagcacggcctgcataccgcccagatcctgctgacccacgacgaccttgccgatcgcaagcgctacctgaacgcccgctcgaccctaaataccctgctcgaactcggcgtcgtccccatcatcaacgagaacgacaccgtcgtcaccgacgagatcaagttcggcgacaacgacaccctcggcgcactggtcgccaatctgatcgaagccgatgcgctgatcatcctgaccgaccagcaaggtctgtacacggccgatccgcgcaaggacccgagcgccacactgatcaacgaagccacggccggcgacgaaacactggaaggcatggccggcggcgccggcacccgcatcggcactggcggcatgatcaccaaggtcattgccgccaaacgcgccgcacgcagcggcgcccataccgccatcgccagcggccgcgaaaccgacccgatcatccgcctggccaatggcgaaccggtcggcaccctactcgtctcgcaaacccaaccgctggctgcccgcaagcaatggcttgctgaccacctgcaactggctggccgcctgatcctcgatgccggcgccgtgaatgcgctacatgccggcaagagcctgctcccgatcggcgttatcgccgccgagggagaattcgaacgcggcgctgccgttgcctgcatcagccccgacggccgagaaatcgcccgcggcctgagcaactacggcagcggcgaagcccggctgatcgcccgcaagaccacccaggaaatcgagaatacactgggctacgtggacgaaccggaaatcatccaccgggacaacctgatcctctcctga

SEQ ID NO: 533 - protein, 372 aa, Dechloromonas aromatica
MNPTRLANAKRLVVKVGSALVTNNGTGLDLSAINDWARQIAVLRQQDKEVVLVSSGAIACGMQRLGWAKRPKSVHELQAAAAVGQMGLVQVYEGAFAKHGLHTAQILLTHDDLADRKRYLNARSTLNTLLELGVVPIINENDTVVTDEIKFGDNDTLGALVANLIEADALIILTDQQGLYTADPRKDPSATLINEATAGDETLEGMAGGAGTRIGTGGMITKVIAAKRAARSGAHTAIASGRETDPIIRLANGEPVGTLLVSQTQPLAARKQWLADHLQLAGRLILDAGAVNALHAGKSLLPIGVIAAEGEFERGAAVACISPDGREIARGLSNYGSGEARLIARKTTQEIENTLGYVDEPEIIHRDNLILS

SEQ ID NO: 534 - DNA, 1122 bp, Dehalococcoides ethenogenes
  CDS (1)..(1122): transl_table=11
atgaacggaaattgttacaaacggattgtaataaagctggggacaagcctgctgaccggaggcacaggcaagcttgaccatgagcgcatggcggatttatgccgccagatagctgacctgacccgtttgggtacggaggtaattattgtttcctccggggcgattgccgccggacgggctaaaatgggtctccggcatatcccgaaagatgtgcctttcaagcaggtgctggcggctataggccagagccagcttatgaattattatgaccagctgttcagcccccacgggctgactgttgcccagggtctgctgaccaagagtgatttgtctgaccgttccggttacttaaacgccagaaataccctgctggctttgatggagctgggagttataactattgtcaatgaaaatgacgtggtggcggtagatgaaatccagcaggccaaattcggggacaatgacaacctgtctgccatggtagccaacctgatagaggctgatttgctgctgatactgactaatatccgcgggctttatacagctgaccccaccctccacccggatgcccggctgataaccgaagttaaagagattaccgaagagctggagaaactggctgccggcagttccaacaagctgggtaccggcggcatggttaccaagctggaagccgccaggctggcaacatcttcaggggtaaatgtcatcatagcagacgggcatatacctgatattatccttaaactggccagcggggaaaccgaaggtacccgctttatgccttcactccacaaaccggacagccgccagcgctggatgatgagcgggctttgcacccgcggcaatatctgcatagatgacggggcggtcaaagctatacgggaaaaccagaaaagcctgcttgccgccggggtacaacaatccgagggcaaattcgggcggggggatattgtaaaactgagcgacagccgcggcaaacggctgggctatggcataaccaattattcttcagatgatgtttcaaagataaaagggctgcatacagacgaaataaacacagttctggcaggcaatcagggcccggaaataattcaccgcaataacctggtggtaatttaa

SEQ ID NO: 535 - protein, 373 aa, Dehalococcoides ethenogenes
MNGNCYKRIVIKLGTSLLTGGTGKLDHERMADLCRQIADLTRLGTEVIIVSSGAIAAGRAKMGLRHIPKDVPFKQVLAAIGQSQLMNYYDQLFSPHGLTVAQGLLTKSDLSDRSGYLNARNTLLALMELGVITIVNENDVVAVDEIQQAKFGDNDNLSAMVANLIEADLLLILTNIRGLYTADPTLHPDARLITEVKEITEELEKLAAGSSNKLGTGGMVTKLEAARLATSSGVNVIIADGHIPDIILKLASGETEGTRFMPSLHKPDSRQRWMMSGLCTRGNICIDDGAVKAIRENQKSLLAAGVQQSEGKFGRGDIVKLSDSRGKRLGYGITNYSSDDVSKIKGLHTDEINTVLAGNQGPEIIHRNNLVVI

SEQ ID NO: 536 - DNA, 1122 bp, Dehalococcoides sp
  CDS (1)..(1122): transl_table=11
atgaacgaaaattgttataaacgggttgtaataaagttgggcaccagtctgctcaccggcggcacaggcaagcttgaccatgagcgcatggctgacctgtgccgacagatagccgaactgacccgcctgggtactgagatagttatagtttcttcgggggctattgccgccggacgctctaaaatgggtatccgccacattccgaaagatgttccttttaaacaagtgctggccgccataggccagagccagcttatgaattattatgaccagttattcagtcctcacgggctgacggttgcccaaggtctgctgaccaaaagtgacctgtctgaccgttcgggttacctcaacgcccgaaataccctgctggctttgatggaactgggaattataaccattgtcaatgaaaatgacgtggtagcaatagatgaaatccagcaagccaaatttggggataatgacaatctgtcggccatggtagccaacctgatagaggctgatttactgctgatactgaccaatatccgcgggctttacacctcagaccctactctccaccctgaagctaccctgataaccgaggtcaaagagattaccgaagaactggagcaactggccgccggcagctcaaacaagctgggtacaggcggaatggtaaccaaactggaagccgccagactggccacatcttcaggggtaaccgccattattgcagacgggcatataccggatattattctcaaactggcgaatggtgaaaatgaaggtacccgttttataccttcactgcacaagccggatagccgccagcgctggatgatgagcgggctttgcacccgcggcagcatctgtgtagatgacggggcagccaaagcactaagagaaaaccagaaaagcctgctggctgccggagtgcaacaggccgaaggcaaattcgggcggggtgatattgtaaagcttaccgacagccacggaaaacggctgggttatggcataaccaattactcttcagatgatatttccaaaataaaaggccttcactcacaggaactaaacgccgttttagggggcaaccaaggccctgaagtaatacaccgcaataatctggtggtaatttaa

SEQ ID NO: 537 - protein, 373 aa, Dehalococcoides sp
MNENCYKRVVIKLGTSLLTGGTGKLDHERMADLCRQIAELTRLGTEIVIVSSGAIAAGRSKMGIRHIPKDVPFKQVLAAIGQSQLMNYYDQLFSPHGLTVAQGLLTKSDLSDRSGYLNARNTLLALMELGIITIVNENDVVAIDEIQQAKFGDNDNLSAMVANLIEADLLLILTNIRGLYTSDPTLHPEATLITEVKEITEELEQLAAGSSNKLGTGGMVTKLEAARLATSSGVTAIIADGHIPDIILKLANGENEGTRFIPSLHKPDSRQRWMMSGLCTRGSICVDDGAAKALRENQKSLLAAGVQQAEGKFGRGDIVKLTDSHGKRLGYGITNYSSDDISKIKGLHSQELNAVLGGNQGPEVIHRNNLVVI

SEQ ID NO: 538 - DNA, 1092 bp, Deinococcus radiodurans
  CDS (1)..(1092): transl_table=11
atgcgcgttgtcctcaagctcggcaccagtgttctgaccgcaggcaccgaccgcctgcaccggccccggctggtagacctgatgcgcgacatcgccgccgtgtcggcgcaggggcacgaggtcgtgctggtcagcagcggcgcggtcacggcgggctgggaagcgctcgggtttccgccgcgcgagcgcaccctcgccgaaaagcaactgctcgcggcggtggggcaggtgcagttgatgcacctctatacgtcgctggccgagctgtatggcctgcgctcggcccagttgctcctcaccgccgacgacttccgcgaacgcacccgctacctcaacgcccgcaccaccctggagggctgcctcagccggggcgtgctgccggttatcaacgagaacgacaccgtggcggtggagcagatcaaggtgggcgacaacgacaccctctcggccttcgtcgccaatctggtggaggccgacctgctgctgatcctgaccgacgcgccgggcctctacaccgccgacccgcgcactcacccggacgccaccctgattccggtggtggagcgcgtgacccccgatatctgggcactggcgggcggcgcgggaagccaccggggcaccggcggaatgcacaccaagattcaggccgccgaaattgccacgcgcgccggcacccccgtcgtcatcgcccccggcgacttgcccgaggccctgcgccgggtggtggacggcgaggcgctcggcacccgctttctggcgcacggcacccgtttggaggcccgcaagcgctggattctggccgaaatcgcgcacgggcggctgctcctcgacggcggcgcggcgcaggcggtgcgcgagcgcggcagcagcctgcttccggcgggcatccggcaggtggagggcgacttcgagcgcggccacaccgtgcgcctgctcgcccccgacggccaggaactcgggcgcggcctgacccgctaccgggccgacgacctgcgccgggtgtgtggccaccattcccgtgagatcgaggcgctgctggggtacacctacggtgaagaggcggtgcaccgtgacgacctggtgctgctctag

SEQ ID NO: 539 - protein, 363 aa, Deinococcus radiodurans
MRVVLKLGTSVLTAGTDRLHRPRLVDLMRDIAAVSAQGHEVVLVSSGAVTAGWEALGFPPRERTLAEKQLLAAVGQVQLMHLYTSLAELYGLRSAQLLLTADDFRERTRYLNARTTLEGCLSRGVLPVINENDTVAVEQIKVGDNDTLSAFVANLVEADLLLILTDAPGLYTADPRTHPDATLIPVVERVTPDIWALAGGAGSHRGTGGMHTKIQAAEIATRAGTPVVIAPGDLPEALRRVVDGEALGTRFLAHGTRLEARKRWILAEIAHGRLLLDGGAAQAVRERGSSLLPAGIRQVEGDFERGHTVRLLAPDGQELGRGLTRYRADDLRRVCGHHSREIEALLGYTYGEEAVHRDDLVLL

SEQ ID NO: 540 - DNA, 1140 bp, Desulfovibrio desulfuricans
  CDS (1)..(1140): transl_table=11
atggactggcagaccgagcgcgggcaggttctggattccgcccgcagagtggttatcaaggtggggagtgcggtgcttacttccggcaacgggctggatgtgggcgtggtggataatctggtggcccagattgccgacctgcacggccgcggcgtagatgtggtgctggtgtcctccggtgcggtttcggccgggcgtgccgtgctgcggcgctgctgcgagataaaaggcatgccgcacaagcaggcggcatcggccgtggggcagagccgtctcatgcactattatgacgaggcgttcggcagacacggcattatttccgcgcagatactgctcaccaaggacgacctgcgcagccgtcaccgttttcttaacgcccgcaacacgtttgcggcacttatggactggcatgccgtgcccattgtcaatgaaaacgacacagtggccgtacgcgaactggaattcggcgacaatgacagtctggccagtctgctgctgaatgtggtggatgccgacctgttcatcaatctgacatcggccggcggagtatatgccgacaaccccgacaccaaccccgatgcgcgtgtcatggaatgcatagaaaatgtgcacgggcttaatctggacgtgatgtgcggcggtaaaaccgctgtggggtcgggcggcatgtattcaaaattgctggcggcacggcgggcagcacagcttggggtgcccacgcttattctgcccggacgcaagcccgatgccatgctgcgggcttttgccggtgacgaacccggaacatgggtgcgaccggaaaagaaaaccgtttcggcacgcaaattctggctggcgtatcacgctgatcccacaggatcggtggtggtggatgacggtgctgtaaaagcgcttgaggcgggcaaaagcctgctgcctgccggaatcatcggtgttgaagggggcttcgggcgtggtgcgcttgtgcgtgtcacttctgcggccggtgccgtggtggctgtgggcctcagcaactaccccgccgccgacctgcggcgcatcatgggccaccgcacggcggaacttacggccattctgggtgacaaccagtatccggaagccatccaccgcgataatatgctgatggacgccgtggtgtga

SEQ ID NO: 541 - protein, 379 aa, Desulfovibrio desulfuricans
MDWQTERGQVLDSARRVVIKVGSAVLTSGNGLDVGVVDNLVAQIADLHGRGVDVVLVSSGAVSAGRAVLRRCCEIKGMPHKQAASAVGQSRLMHYYDEAFGRHGIISAQILLTKDDLRSRHRFLNARNTFAALMDWHAVPIVNENDTVAVRELEFGDNDSLASLLLNVVDADLFINLTSAGGVYADNPDTNPDARVMECIENVHGLNLDVMCGGKTAVGSGGMYSKLLAARRAAQLGVPTLILPGRKPDAMLRAFAGDEPGTWVRPEKKTVSARKFWLAYHADPTGSVVVDDGAVKALEAGKSLLPAGIIGVEGGFGRGALVRVTSAAGAVVAVGLSNYPAADLRRIMGHRTAELTAILGDNQYPEAIHRDNMLMDAVV

SEQ ID NO: 542 - DNA, 1143 bp, Desulfovibrio vulgaris
  CDS (1)..(1143): transl_table=11
atggagtggacggaggaacgcgccgcagccctgcgcgaggcgcgttgcgtagtggtcaaggtgggcagtgccgtgctgaccaccgaaacgggcgtcaatcttgccgtcatcgacagtctcgccgcccagctttcggccttgcaggaatctggcaagcgggtggtgctcgtctcttcgggtgctgtggctgccgggcgcagtgccttgcgcgactgctgcgagattgccggaatgccgcataagcaggcggcttcggccgtagggcaaagccgtctcatgcatcactatgacgaggcgttcgcccgttacgggcatctctcggcgcaagtgcttctcacccgggacgacctgcggaaccgtgagcgttttctcaacgcacgcaacacgttccaggcgcttctcgactggggggtcatcccggtcgtcaacgagaacgacaccgtggcggtgcaggaactcaagtttggcgacaacgactgccttgccagcctgctgctcaacgtcgtcgagggcgacctgtacgtcaacctcacctccgcgtcgggtgtctatgccgacaacccgcagaccaatcccgaagccggtatcctgccgtgcatcgaggacgtgcacacgctcgacctcgatgtgatgtgcggaggcaagacgtctgtcggtaccggcggcatgtactccaagctgctggctgcaagccgcgccgcacaactgggggtgccgacgctcattcttccggggcgtgaaccgcgcatcctcgaacgtgccttctcgggtgaacccgtggggacatgggtgcgccccgaggcacgagtcgtgtcgcgccgcaagtactggctggcgtaccagtccgaaccttcggggacggtgacggtggacgagggtgcggcccgtgcgctgttgcagcaaggtggaagcctgcttccgggcggcgtctgcgatgtctccggcgcattcgaacccggggcgcttgtgcgtatcgccgggccggacggaaccgtcattgccgtgggtttgtcgaattacggcgaccgtgaccttgtgcggataaaggggcatcgacgtcacgaggtggctgccattctcggtgatgcccatttcccggaagtggtgcaccgcgacaacatgcttctggacgccgtggtatag

SEQ ID NO: 543 - protein, 380 aa, Desulfovibrio vulgaris
MEWTEERAAALREARCVVVKVGSAVLTTETGVNLAVIDSLAAQLSALQESGKRVVLVSSGAVAAGRSALRDCCEIAGMPHKQAASAVGQSRLMHHYDEAFARYGHLSAQVLLTRDDLRNRERFLNARNTFQALLDWGVIPVVNENDTVAVQELKFGDNDCLASLLLNVVEGDLYVNLTSASGVYADNPQTNPEAGILPCIEDVHTLDLDVMCGGKTSVGTGGMYSKLLAASRAAQLGVPTLILPGREPRILERAFSGEPVGTWVRPEARVVSRRKYWLAYQSEPSGTVTVDEGAARALLQQGGSLLPGGVCDVSGAFEPGALVRIAGPDGTVIAVGLSNYGDRDLVRIKGHRRHEVAAILGDAHFPEVVHRDNMLLDAVV

SEQ ID NO: 544 - DNA, 1104 bp, Erwinia carotovora subsp
  CDS (1)..(1104): transl_table=11
atgagcggcagccagactttggttgtgaaactgggcaccagcgtgttaaccggcggttcacgccgtcttaaccgtgctcacattgttgaactggtgcgccagtgcgcgcagcaacatgcggcagggcaccggattgttattgtcacctcaggggcgattgctgctgggcgcgaacatttgggctaccccgaactcccggccacgattgcaaccaaacaactgctggccgccgtgggccaaagccgcctgattcaactgtgggaacagctgttttccatctacggtatccacgtcgggcagatgctgctgacgcgtgcggatatggaagatcgtgagcgtttcctcaatgcacgtgacaccatgcgggcgctgctggataacaacatcgttccagtgattaatgaaaacgatgcggttgcgaccgctgagatcaaggtcggcgataacgacaacctgtccgcgctggccgcgattctggccgatgcggataagctactgttgctaaccgatcaggcggggctgtttaccgccgatccgcgtaataatcctgatgcggaactgatccgtgaagtgaccggcatcaacgatgcgctgcgcagtattgcgggtgacagcgtgtctggcctcggaacgggcggcatgtcgactaagttgcaggctgccgatgtggcctgtcgcgccggcatcgacgtggtgattgccgcaggcagcaaaccgggcgtgattggcgatgtgattgctgatatttccgtcggaacacgttttcatgcactggatacgccgctggaaagccgcaaacactggatttttggtgcaccaccggcgggggaaatcaccgtcgatgacggcgcgctttcggcgatcctcgaacgcggtagctcgctgctgcctaaaggtatccgcacggtagaaggcaatttctctcgtggcgaagtgattcgcgtgcgtagcctagcgggccgcgatgtggcgcatgccgtgacgcgttacaacagcgatgcgctgcgcctgattgccggacatcattctcaacagattgccgagattcttggctacgaatatggtccggtggctatccatcgcgacgatatgattatcaattaa

SEQ ID NO: 545 - protein, 367 aa, Erwinia carotovora subsp
MSGSQTLVVKLGTSVLTGGSRRLNRAHIVELVRQCAQQHAAGHRIVIVTSGAIAAGREHLGYPELPATIATKQLLAAVGQSRLIQLWEQLFSIYGIHVGQMLLTRADMEDRERFLNARDTMRALLDNNIVPVINENDAVATAEIKVGDNDNLSALAAILADADKLLLLTDQAGLFTADPRNNPDAELIREVTGINDALRSIAGDSVSGLGTGGMSTKLQAADVACRAGIDVVIAAGSKPGVIGDVIADISVGTRFHALDTPLESRKHWIFGAPPAGEITVDDGALSAILERGSSLLPKGIRTVEGNFSRGEVIRVRSLAGRDVAHAVTRYNSDALRLIAGHHSQQIAEILGYEYGPVAIHRDDMIIN

SEQ ID NO: 546 - DNA, 1125 bp, Geobacillus kaustophilus
  CDS (1)..(1125): transl_table=11
atgaaacggcagcgcgtggtggtcaaaatcggcagcagctcgctcaccgatccgaaaggcggcctttgccatgacaaactgttcgatcacgttgaggcgatcgcttatctcaaacagctcggccatgacgtcattctcatcacgtccggcgctgtcgccgctggtttcggacctttaggctacccggcgcgcccgacgacaatcgctgggaaacaggcagccgcagccgtcgggcaaagtttgctcatgcaggcgtacagctcggcgttcgcccaattcggctttacggccgctcagctgttgttgacgcgcagcgacttttacagccgcgagcggttccgcaacttgtttgccacaatcaccacactgcttgagaacggcgccgtgccgatcattaatgaaaacgactccgtttccatcgaagaattgacatttggcgacaatgacatgctttcggcgcttgtcgccggctttttgcacgctgatgcgctcattttgcttacggacattaacgggttgtatgacgccaatccgaaaacgaatccgcaggcgaaaaaatacgcctttttgccggaaatcaccgatgagatgatcgaagccgccggcggcatcggttcagccgtcggcaccggcgggatgcgctcgaagcttctcgcggctcgaaaagcactttcgtttggcgtcagcgtgttcatcggcacgggaagcggccgagaaaaactggctgatattttagctggaaaaggagacggcacgtacatcggcgttccgtttccgaaacaaatgcaaatgcgcaaacaatggattgcctatcatgctcctgtcgccggcatgatcacggtcgacagcggggctgaagaagcgttgcttatgcgtgggaaaagtttgctccctgctggcgtaacagcggtttccggcgacttccatgcgatggatgtcgtggatgtcgtcaatgaaaaagggatcacgatcggacgcggccaagtgtattacgccgccgccgatttgaaaaaagtgaaagggcggccgagcgaagaggcccggcaatactcttaccttcaccgcccggaagtcatccaccgcgacaattgggtcacgttgcgaaaggagagtgtatcgaaatga

SEQ ID NO: 547 - protein, 374 aa, Geobacillus kaustophilus
MKRQRVVVKIGSSSLTDPKGGLCHDKLFDHVEAIAYLKQLGHDVILITSGAVAAGFGPLGYPARPTTIAGKQAAAAVGQSLLMQAYSSAFAQFGFTAAQLLLTRSDFYSRERFRNLFATITTLLENGAVPIINENDSVSIEELTFGDNDMLSALVAGFLHADALILLTDINGLYDANPKTNPQAKKYAFLPEITDEMIEAAGGIGSAVGTGGMRSKLLAARKALSFGVSVFIGTGSGREKLADILAGKGDGTYIGVPFPKQMQMRKQWIAYHAPVAGMITVDSGAEEALLMRGKSLLPAGVTAVSGDFHAMDVVDVVNEKGITIGRGQVYYAAADLKKVKGRPSEEARQYSYLHRPEVIHRDNWVTLRKESVSK

SEQ ID NO: 548 - DNA, 1122 bp, Geobacter metallireducens
  CDS (1)..(1122): transl_table=11
atgcgcacagccatcctcaaaaaggtcaaacggatcgtcatcaagatcgggagccgtgtcctcaccggcgacgagaacggcctcaaccacgccttcatcgcccggcttgccgccgagaccgcatcgttgcgacagcaggggcgccaggtcatcgtcgtttcatcgggtgccgtggctgccggcaggcgcgaactcggcatcgagggacggcccaagagcattccccagaagcaggccgctgccgccatcggccagtcacgcctcatgcgggcctacgaagaggacttcggccgcttcggccacaaggtggcacagatactcctcacccgggacgatctcgccaaccgccgccgtttcctgaacgcccgggcaacccttgacacgctcctggacttcggcgtcattcccgtcatcaacgagaacgacaccgtggtggtggacgagatcaagttcggcgacaacgacaacctgtcggccctggtgaccaacctggccgaggcccacctcctggtgatcctgaccgacatcgacggcttctacgactccgacccccgggcgaaccccgatgccaggctgatccacctggtgaagagcatcacccgcgaaacggagcgggccgccggcgacagcggctccagcgtgggcaccggcggcatggtgacgaagctggccgcagccaagaaggcggggcagttcggcgtcccgaccctcatgctcaacggcacggtgccgggcattctcaccaaggcctttgccggccgggaggtgggaaccctcttccttcccgcccgggagagcctcaaccgccgcaagcactggatcgcccacaccctgcgccccagcggccgagtcatcgtggacgacggagcccggacggtcctctcccgtcaggggaaaagtctcctcccctcgggggtaatccgagtggagggagagttcgaccgaggggcctgtgtccgggtttgcggggccgacggcgccgaaatcgcccggggggtggtggactactcccacgccgaaatcgagcggatcctcggccaccggagcggcgagatcgaggcgatcctcggctacaagtacggagacgagatcatccaccgggacaacctggtggtgctataa

SEQ ID NO: 549 - protein, 373 aa, Geobacter metallireducens
MRTAILKKVKRIVIKIGSRVLTGDENGLNHAFIARLAAETASLRQQGRQVIVVSSGAVAAGRRELGIEGRPKSIPQKQAAAAIGQSRLMRAYEEDFGRFGHKVAQILLTRDDLANRRRFLNARATLDTLLDFGVIPVINENDTVVVDEIKFGDNDNLSALVTNLAEAHLLVILTDIDGFYDSDPRANPDARLIHLVKSITRETERAAGDSGSSVGTGGMVTKLAAAKKAGQFGVPTLMLNGTVPGILTKAFAGREVGTLFLPARESLNRRKHWIAHTLRPSGRVIVDDGARTVLSRQGKSLLPSGVIRVEGEFDRGACVRVCGADGAEIARGVVDYSHAEIERILGHRSGEIEAILGYKYGDEIIHRDNLVVL

SEQ ID NO: 550 - DNA, 1122 bp, Geobacter sulfurreducens
  CDS (1)..(1122): transl_table=11
atgcgtagcggaatcctctccaaggtcaagcggatcgtcatcaagatcggcagtggggtcctcacctgtggggacaacgggctcaacaagcccctcatgggcagcatcgccgcccaggtggccgagctgcgcgccagcggccgccaggtgatcatcgtctcctcgggcgccgttgccgcggggcggaaagagctcggcatcgacggcagaccccggagcattccccagaagcaggcggcggcggccatcggccagtcgcgcctcatgcacgcctacgaggaggccttcgagcccttcggccacaaggtggcgcagatccttctgacccgcgacgacctggcccaccggggacggtttctcaacgcccgggctacccttgataccctcctctccttcggggtgatcccgatcatcaacgaaaacgacactgtggtcttcgacgagatcaagttcggcgacaacgacagcctctccgccctggtcaccaacctggccgaggccaatctgctggtgatcctgaccgacatcgacggtttctacgaggcgaatccccgtaccaaccccgacgcgcggctcattcccctggttcggcagatcacccgggagatggaacgggctgccggcggcagcggttccaccgtcggcacgggcgggatggtaaccaagctggctgcggccaagaaggccggccagttcggggtgccgacgctcatgctcaacggcaggaatccgtccctgctggccgaagcctttgccggccgcgaggtggggaccctgttcctccccggcaaggagagcctcaaccggcgcaagcactggattgcccatactctgaggccgtcggggaaaatcatcgtggacgacggcgcccgcacggtccttgcccgccaggggaaaagcctgctaccgtcgggggtggtccgggtcgaggggaagttcgaccggggcgcctgcgtccgggtctgcggcaccgacggcactgagatcgcccgggggctcgtagactattcccatgacgagatcacccgcatcctcggtcatcgaagtggcgagatcgaggccatcctcggctacaagtacggggacgagatcatccaccgggacaatcttgtggtgctgtag

SEQ ID NO: 551 - protein, 373 aa, Geobacter sulfurreducens
MRSGILSKVKRIVIKIGSGVLTCGDNGLNKPLMGSIAAQVAELRASGRQVIIVSSGAVAAGRKELGIDGRPRSIPQKQAAAAIGQSRLMHAYEEAFEPFGHKVAQILLTRDDLAHRGRFLNARATLDTLLSFGVIPIINENDTVVFDEIKFGDNDSLSALVTNLAEANLLVILTDIDGFYEANPRTNPDARLIPLVRQITREMERAAGGSGSTVGTGGMVTKLAAAKKAGQFGVPTLMLNGRNPSLLAEAFAGREVGTLFLPGKESLNRRKHWIAHTLRPSGKIIVDDGARTVLARQGKSLLPSGVVRVEGKFDRGACVRVCGTDGTEIARGLVDYSHDEITRILGHRSGEIEAILGYKYGDEIIHRDNLVVL

SEQ ID NO: 552 - DNA, 1110 bp, Gloeobacter violaceus
  CDS (1)..(1110): transl_table=11
atggtcgcgctggtggtcaaaatcggcacatcgagcctgagcgacccgagcacaggggatttgcgcctggcgacgcttggggggctcgccgagacgctcacgcggctgcggcgcgcgggccaccggatcatcctggtcagcagtggggcggtgggggtcggctgcgcacggctcggcctcaaggagcgccccgccaccgtggcgggcaagcaggccgccgccgccgtcgggcaggggctgctgatgagcatgtacgatcgcctcttcggagcgctcggccaaccggtggcccaggtattactcacccgccaggatttgatggaccgcgtccgctacctcaacgcccgcgaaacgttgagcgaattgtggcgactcgggacggtgcccatcgtcaacgaaaacgacacggtggccaccgacgagttgcgcttcggggacaacgacgccctctcggcgctggtggcggggctggtcgaggcgcagtggctggtgctgctcaccgacgtggccgggctctactcggccaacccgcgcctcgatccgcaggcacggcttttgtccgaggtgaccgagatttctgaagaactgctgcagtcggcccgcgggcgcagcctctggggcagcggcggcatggcgagcaaactggaggcggcgcgcatcgccgcgagcgccggggtggccaccgtgatcaccgagggaaacaccccgcaaaatatcgagcgcatcctggcgggcgaagcaatcggcacccgatttgccctggcgcggcccggggggcgtctgtcgctgcgcaagcgctggatcggctacggtctggtgcccgccggggcgctccacctcgacgagggggcggtcctggcggtgcgcgaagggggcaaatcgctgctgccggccggggtgaggggcgtggaaggccgcttcgagacgggagcgctggtgcggctcatcgacgggcagggcctcgaatttgcccgggggctcgtgaattattccagcgaagaactggaaaaaatccgcggccgcaaaagccatgagattgccgcgcttttgggtatcgaaggacaaccgcccacggccgtgcaccgcgacaatctggtcaccctttcttga

SEQ ID NO: 553 - protein, 369 aa, Gloeobacter violaceus
MVALVVKIGTSSLSDPSTGDLRLATLGGLAETLTRLRRAGHRIILVSSGAVGVGCARLGLKERPATVAGKQAAAAVGQGLLMSMYDRLFGALGQPVAQVLLTRQDLMDRVRYLNARETLSELWRLGTVPIVNENDTVATDELRFGDNDALSALVAGLVEAQWLVLLTDVAGLYSANPRLDPQARLLSEVTEISEELLQSARGRSLWGSGGMASKLEAARIAASAGVATVITEGNTPQNIERILAGEAIGTRFALARPGGRLSLRKRWIGYGLVPAGALHLDEGAVLAVREGGKSLLPAGVRGVEGRFETGALVRLIDGQGLEFARGLVNYSSEELEKIRGRKSHEIAALLGIEGQPPTAVHRDNLVTLS

SEQ ID NO: 554 - DNA, 1137 bp, Gluconobacter oxydans
  CDS (1)..(1137): transl_table=11
atgaccgctccggcttctgctcctcgtctggcgcaggcccgccggatcgtcatcaagatcggaagtgcgcttctggtcgattccgcgaatgcaagccttcgtcttgaatggctgcagagcgtctgtgcggatattgctgacctgcgttcccggggcgcggaagtcatcgtcgtgtcctcgggcgcgatttccctggcgcgacatcgcctcggcctgacatcccgccgccttcggctggacgaaaaacaggccatggccagtgtcggccagatcggactggcgcaaggctggagcgcagccctcgccggccatgatctggtcgcggcccagcttcttctgaccccggacgatacggaaaaccgtgagcgccacctcaacgcgcgcgccacgctccagaccctgctcgatctgggctgcgttcccgtcatcaacgaaaacgatgccatcgcgaccggcgagatccgcttcggcgacaatgaccgcctgggcgcgcgtgtggcccagatgaccggggccgactgtctggtcctgctgtccgacatcgacgggctctatacagcggacccgcgacaggatccgtccgcgcggcatattcctgttgtcgaacagatgacggacgagatcatggcgatgggaggcgagccgccgccgggttattcgtctggcggaatgcgcacgaagctcctcgcggcccggattgcgacgcgcgcgggtgcaaacatggtgatcgcggccggacaggagcatcatccgctccgcagactgcagaatggcgggctgtgcacatggttcatggcgcagaccgatgccggctcagcccgcaagcgctggatcggtggcagccttcagcccaaggggacacttacgatcgatgccggcgcccgtcgtgctcttgaagagagcgcatcccttctgccagcaggcgtgaccggccttgagggcagttttgggcgcggcgacctggtactcatccgtgatgctgacggcagcattatcgggcgcggtctgatcgcctatgattccgaggagagccagaagctgattggccatcgctccggcgagatggaacagcttctgggatatcgcggacgtgatgccctgatccatcgggatgatctggcgctcgatcttccctga

SEQ ID NO: 555 - protein, 378 aa, Gluconobacter oxydans
MTAPASAPRLAQARRIVIKIGSALLVDSANASLRLEWLQSVCADIADLRSRGAEVIVVSSGAISLARHRLGLTSRRLRLDEKQAMASVGQIGLAQGWSAALAGHDLVAAQLLLTPDDTENRERHLNARATLQTLLDLGCVPVINENDAIATGEIRFGDNDRLGARVAQMTGADCLVLLSDIDGLYTADPRQDPSARHIPVVEQMTDEIMAMGGEPPPGYSSGGMRTKLLAARIATRAGANMVIAAGQEHHPLRRLQNGGLCTWFMAQTDAGSARKRWIGGSLQPKGTLTIDAGARRALEESASLLPAGVTGLEGSFGRGDLVLIRDADGSIIGRGLIAYDSEESQKLIGHRSGEMEQLLGYRGRDALIHRDDLALDLP

SEQ ID NO: 556 - DNA, 1107 bp, Haemophilus influenzae
  CDS (1)..(1107): transl_table=11
atgaacaaaaaaacaatcgttgtgaaattcggtactagcacgctaactcagggttcgccaaaattgaattcgccacatatgatggaaatcgttcgtcaaattgcacaactgcataatgatggatttcgtatagtaatcgtgacttctggtgctattgcagcgggtcgccattatttaaatcatcctcaattaccacccactattgcctcaaagcaactgcttgcagcggttggtcagagccaattaattcaggcttgggaaaaattatttgctatttatgatattcatatcgggcaacttttattaactcgtgctgatattgaagatcgcgaacgttttttaaatgcacgagatactttacatgcacttttagataaccacattattcctgtgattaatgaaaatgatgcggtggcgactgcggaaataaaagtaggagacaatgacaatttatctgcactagtcgctattcttgtgcaagcggaacaactttatttattgactgatcaacaaggtttatttgatagtgatccgcgtaaaaatcctgaagcaaaattaattccagttgtagaacaaatcactgatcacattcgatcaattgcaggaggaagtggtacaaatcttggcacaggtggaatgatgactaaaatcattgctgccgatgttgccactcgctctggaattgaaacaattattgcaccaggtaatcgtccaaatgtaattgcagatcttgcttatgaacaaaatattggtacaaaatttattgcacaccaatctgatcgattagaaagtcgcaaacaatggcttttcgccgcgccatcggcaggcattatcactattgatgatggagcgaaaaatgccattcttgaacaaaataaatctttattacccgctggtattattaacgtggaagggcgtttttcgcgtggtgaagtagtcaaaatatgcactcaatctggtaaagacattgtactaggtatgccacgctataacagcgatgctctacaattaattaagggcagaaaatcagcagatattgaaaatgttttaggctatgaatatggtgcggtggcaatgcatcgtgatgatatgattattttgtcataa

SEQ ID NO: 557 - protein, 368 aa, Haemophilus influenzae
MNKKTIVVKFGTSTLTQGSPKLNSPHMMEIVRQIAQLHNDGFRIVIVTSGAIAAGRHYLNHPQLPPTIASKQLLAAVGQSQLIQAWEKLFAIYDIHIGQLLLTRADIEDRERFLNARDTLHALLDNHIIPVINENDAVATAEIKVGDNDNLSALVAILVQAEQLYLLTDQQGLFDSDPRKNPEAKLIPVVEQITDHIRSIAGGSGTNLGTGGMMTKIIAADVATRSGIETIIAPGNRPNVIADLAYEQNIGTKFIAHQSDRLESRKQWLFAAPSAGIITIDDGAKNAILEQNKSLLPAGIINVEGRFSRGEVVKICTQSGKDIVLGMPRYNSDALQLIKGRKSADIENVLGYEYGAVAMHRDDMIILS

SEQ ID NO: 558 - DNA, 1107 bp, Haemophilus influenzae
  CDS (1)..(1107): transl_table=11
atgaacaaaaaaacaatcgttgtgaaattcggtacaagcacgctaactcagggttcgccaaaactgaattcgccacatatgatggaaatcgttcgtcaaattgcacaactgcacaatgatggatttcgtatagtgatcgtgacttctggtgcgattgcagcgggtcgccattatttaaatcatcctcaattaccacccactatcgcctcaaagcaactgcttgcagcggttggtcagagccaattaattcaggcttgggaaaaattatttgctatttatgatatccatatcgggcaacttttattaacccgtgcagatattgaagatcgcgaacgttttttaaatgcgcgagatactttatacgcacttttagataaccacattattcctgtgattaatgaaaatgatgcggtagcgactgcggaaattaaagtaggagacaatgacaatttatcggcattagtcgctattcttgtgcaagcggaacagctttatttattgactgatcaacaaggtttatttgatagtgatccacgtaaaaatcctgaagcgaaattaattccagttgtagaacaaatcaccgatcatattcgatcaattgcaggaggaagtggtacaaatcttggtactggtggaatgatgaccaaaatcattgctgccgatgttgcgactcgctctggaattgaaaccattattgctccaggtaatcgcccaaatgtaattgcagatcttgcttatgaacaaaatattggtacaaaatttattgcacaccaatctgatcgattagaaagccgcaaacaatggcttttcgccgcaccatcggcaggtattattaccattgataacggtgcgcaaaatgccattcttgaacaaaataaatctttattacccgctggtattattaacgtggaagggcgtttttcgcgtggtgaagtagtcaaaatacgcactcaatcaggtaaagacattgcgctgggtatgccacgctataacagcgatgctctacaattaattaagggcagaaaatcagcagacattgagaatgttttaggctatgaatatggcgcagtggcaatgcatcgtgatgatatgattattttgtcataa

SEQ ID NO: 559 - protein, 368 aa, Haemophilus influenzae
MNKKTIVVKFGTSTLTQGSPKLNSPHMMEIVRQIAQLHNDGFRIVIVTSGAIAAGRHYLNHPQLPPTIASKQLLAAVGQSQLIQAWEKLFAIYDIHIGQLLLTRADIEDRERFLNARDTLYALLDNHIIPVINENDAVATAEIKVGDNDNLSALVAILVQAEQLYLLTDQQGLFDSDPRKNPEAKLIPVVEQITDHIRSIAGGSGTNLGTGGMMTKIIAADVATRSGIETIIAPGNRPNVIADLAYEQNIGTKFIAHQSDRLESRKQWLFAAPSAGIITIDNGAQNAILEQNKSLLPAGIINVEGRFSRGEVVKIRTQSGKDIALGMPRYNSDALQLIKGRKSADIENVLGYEYGAVAMHRDDMIILS

SEQ ID NO: 560 - DNA, 1122 bp, Mannheimia succiniciproducens
  CDS (1)..(1122): transl_table=11
atggaacaaaaacaaaactcgcaaaaaaccattgtagtgaaattcggtaccagcacattaactcaaggtacgccaaaattaaatcgcgcccacatgatcgaaatcgtgcgtcaattggcgcaattacatcaggaaggttatcgtcttgtaattgtcacatccggcgcaatggcggcgggcaggcattatcttaatcacccgaaacttccgcccacaatcgcctcaaaacaattattggcggcggttggacaaagccagctgattcaaacgtgggaacaactatttgccatttacgatattcatatcggtcagcttttattaacccgcgccgatattgaagaccgcgaacgctttttaaatgccagagatacgcttcacgcgttattggataaccgcattattccggtcgtaaatgaaaacgacgccgtcgccaccgcagaaatcaaagtaggcgataacgacaacttatcggcgttagtggcgattttagtacaggcggaacaactttatttgctcaccgaccaacaaggattatttgactccgatccgcggaaaaatccacaggcaaagctaatcccggtggtaaatgaaattaccgatcatattcgttctattgccggcggtagcggtacaaccttaggcacaggcggaatgtccaccaaaattaccgccgccgacattgcaacccgttccggcattgaaacaatcattgctccgggaaacagggaaaatgttatcgccgatcttgcccacggcgaagctataggtacgaaatttacggttcagaccgataaactggaaagccgtaaacaatggctctttgccgcgccttccgccggcattctgaccatcgatcaaggggcggaaaatgcaatattagaacaacataagtctttattgccggcgggtattgtaaatattgaaggtcgtttctcccgcggagaagtggtaaaaatccgcacccaacaaggcaaagatatcgcccttggcatgccgcgttacaacagcgatgcgctttatctcattcaaggcaaaaaatctcagaatattgaaaaaattctgggttatgaatacggctctgtggcgattcaccgcgatgatatgatcgtgttaaacaaataa

SEQ ID NO: 561 - protein, 373 aa, Mannheimia succiniciproducens
MEQKQNSQKTIVVKFGTSTLTQGTPKLNRAHMIEIVRQLAQLHQEGYRLVIVTSGAMAAGRHYLNHPKLPPTIASKQLLAAVGQSQLIQTWEQLFAIYDIHIGQLLLTRADIEDRERFLNARDTLHALLDNRIIPVVNENDAVATAEIKVGDNDNLSALVAILVQAEQLYLLTDQQGLFDSDPRKNPQAKLIPVVNEITDHIRSIAGGSGTTLGTGGMSTKITAADIATRSGIETIIAPGNRENVIADLAHGEAIGTKFTVQTDKLESRKQWLFAAPSAGILTIDQGAENAILEQHKSLLPAGIVNIEGRFSRGEVVKIRTQQGKDIALGMPRYNSDALYLIQGKKSQNIEKILGYEYGSVAIHRDDMIVLNK

SEQ ID NO: 562 - DNA, 1134 bp, Meiothermus ruber
  CDS (1)..(1134): transl_table=11
atgcacggtcgtcttcccctcaccgcccaaacccatcgccggctggtagtcaaggtgggcagcgccgtcctgagcgggccccaggggcggcagcaccaactggccattgccgcccaggtggccgccctgcgggccgaggggcgcgaggtggtgctggtctcctcgggggcccaggccaccggcatgcaaaagctgggcctgaccgaaaagcccaagtccatgcccggcaaacaggccctggccgccgtcgggcagcccaccctcatgctcctgtgggagcaggcttttagctggtacgacctgaaggtggcccaggtgttgctcaccgccgaagatctggcccaccgccaccgctacctgaacgcccggcagaccctggagacgcttttggagtggggcatcgtgcccatcatcaacgagaacgacacggtaatggtggaggagatcaagtttggcgacaacgaccagctttcggccctgattgcttcgctggtaggggccgatctgctgatcttgctctccgacatcgaggctttgtacgaggccgacccccgcacccaccccgaagcccagcccatcccctacgtggagcgggtggatgccggggtgctgcgcatggcaggcgacagtcccaaccgggtgggcaccggcgggatgaaaagcaagctgctggccgcggaaaaagctcaggccgccgggattccccacctgctgctgcccggcacccggccccagagcatcgccgaggccctgcaaggcgccccggtgggcacgctgtttgccggggggcagcgccgctacagcggccgtaagctctggctgtaccagctccccaagccccagggggaggtggtggtggacgccggggcggcgaaagccttacgccagggcggggcctcgctcctgccggcgggcatcctcgaggtgcgcgggcagtttggggtgggcgaggcggtcaggtgcctggacgagcagggcaacctgatcggggtgggcctggtcaactacagcgccgccgagctcgcccgcatcaagcgccgaaaaaccagggagatcgaggccctgctgggctacaaaaacaccgacgaggccatccaccgcgactactttgccctggcctcggagctcgagtga

SEQ ID NO: 563 - protein, 377 aa, Meiothermus ruber
MHGRLPLTAQTHRRLVVKVGSAVLSGPQGRQHQLAIAAQVAALRAEGREVVLVSSGAQATGMQKLGLTEKPKSMPGKQALAAVGQPTLMLLWEQAFSWYDLKVAQVLLTAEDLAHRHRYLNARQTLETLLEWGIVPIINENDTVMVEEIKFGDNDQLSALIASLVGADLLILLSDIEALYEADPRTHPEAQPIPYVERVDAGVLRMAGDSPNRVGTGGMKSKLLAAEKAQAAGIPHLLLPGTRPQSIAEALQGAPVGTLFAGGQRRYSGRKLWLYQLPKPQGEVVVDAGAAKALRQGGASLLPAGILEVRGQFGVGEAVRCLDEQGNLIGVGLVNYSAAELARIKRRKTREIEALLGYKNTDEAIHRDYFALASELE

SEQ ID NO: 564 - DNA, 1173 bp, Mesorhizobium sp
  CDS (1)..(1173): transl_table=11
atgagtggaatttcgctttcctcttatcgccgcgtgaccgtgaagatcggctctgccctgctggtcgatcgcgcggcagggttgaagcgtgagtggctcgccgcccttgttgacgatattgcccggctcatgtcggctggcacggaagtgctcgttgtatcctccggcgccattgccctgggacgcacggtgctgggccttggaaagcgcacattaaggctcgaggagagccaggccgcggcggccgtggggcagatcgcacttgcgggcgcgtggtcgggcgagctcggccgccacgggctcatctccggccaggtgctggttacattgggtgatacggaagaacgccgccgctacctcaacgcccgggcaacgatctcgacgcttctcaaaatgaaggccgttccagtcatcaatgagaacgacaccgtggcgaccagcgaaatccgatacggggacaacgaccggttggctgcgcgcgtcgccactatgatgggcggcgacctcctcatactcctgtccgatgtggatgggctttacacggctccgcccgagcgcgatcctgcggcaaagttcatcccggtcgtggatgccatcacgccggaaattatggctatgggcggggctgccgcctcggagctatcccgagggggcatgcgcaccaagctcgatgccgggcggatcgccaccgcggcgggtacggcaatgatcatcgcatcggggaaggagcgcggcccgctgtccgcgatcgagcgcggcgcgcgcgctaccctcttcaagccgagccccacgccggttcgcgcctacaagacctggatcgcgggtcaactcgagcccgccggccgtatcgggatcgatgacggcgcgttgagggcgctgcttcagggcaagagcctgctaccggcaggtgtgaggcgggtcgagggtgtcttctcccgtggcgacaccgtggcgatcgttgattccgcggggcgtgagattggccgggggctggttgcctatgatgccgccgatgccgtaaagatcgctgggctgaaaacgggcgatattgctggaatcctgggttacgaagcgcgagcggccatggtgcaccgggacgacctggtcctttccgggcctactggcgagctcatggatcgcaaggtggaaggaatcgatgttgcaggtgcgtga

SEQ ID NO: 565 - protein, 390 aa, Mesorhizobium sp
MSGISLSSYRRVTVKIGSALLVDRAAGLKREWLAALVDDIARLMSAGTEVLVVSSGAIALGRTVLGLGKRTLRLEESQAAAAVGQIALAGAWSGELGRHGLISGQVLVTLGDTEERRRYLNARATISTLLKMKAVPVINENDTVATSEIRYGDNDRLAARVATMMGGDLLILLSDVDGLYTAPPERDPAAKFIPVVDAITPEIMAMGGAAASELSRGGMRTKLDAGRIATAAGTAMIIASGKERGPLSAIERGARATLFKPSPTPVRAYKTWIAGQLEPAGRIGIDDGALRALLQGKSLLPAGVRRVEGVFSRGDTVAIVDSAGREIGRGLVAYDAADAVKIAGLKTGDIAGILGYEARAAMVHRDDLVLSGPTGELMDRKVEGIDVAGA

SEQ ID NO: 566 - DNA, 1125 bp, Methylococcus capsulatus
  CDS (1)..(1125): transl_table=11
atgcagagcaggaatgagctccctggcagccggcgcgtcatcgtcaagatcggcagcgccctgctgaccgcaggcggcaaaggactggaccaacctgccatcggccaatgggtgcagcagatcgcggaactgcgccagcaggggatccaagtggtgctggtttcctcgggctcggtcgccgaaggcatgtcgcggctgggctggaagacccggccgcatcggctgaatgagctccaggccgccgcctcggtcggccagatggggctggtgcagacttacgaaagtctgttcaagcggcacggcctgcagacagcgcagatcctcttgacccacgacgacctgtcgaaccgggagcgctatctcaactcgcgcagcaccatactcacattactcgagctcggagtcatcccggtcatcaacgaaaacgacaccgtcaccacggaagaaatccgcttcggcgacaacgacacgctgggtgcgctggtggcgaatgcggtcgaggccgatctgctcatcattctgacagaccaggccggactgttcgagcgcaacccctcgctcgacccctcggccccgctggtcccccaagccggtatcaacgatccccggctcaatgacatggtcggggacagtctgagcggtctgggccggggaggcatgattaccaagctacgtgcggcacggctggcggcccggtcgggaacggccacggtgatcgccagcggcagggaaagcggagtactgcctcgcattctcgacggagaagagctgggcacactgctgattccggacgtttcccctctgatcgcccgcaagcgctggatggccggacagctcaaattgaaaggatgtttcgtggttgacgaaggcgccgcaagggtattgcgggacgccgggaagagcctgttgccgatcggcgtaatcgccgtggagggcgaattccggcgcggcgacctcgtagcctgcacggattccgcgggccaggaaatcgcacgcggactgaccaactacagcgctgaagaagcccgtctcatcatgcgccagccgagcacgcggatcgaggagatcctgggatacgtggacgagccagaactcatccaccgcgacaatctggtgttgagctga

SEQ ID NO: 567 - protein, 374 aa, Methylococcus capsulatus
MQSRNELPGSRRVIVKIGSALLTAGGKGLDQPAIGQWVQQIAELRQQGIQVVLVSSGSVAEGMSRLGWKTRPHRLNELQAAASVGQMGLVQTYESLFKRHGLQTAQILLTHDDLSNRERYLNSRSTILTLLELGVIPVINENDTVTTEEIRFGDNDTLGALVANAVEADLLIILTDQAGLFERNPSLDPSAPLVPQAGINDPRLNDMVGDSLSGLGRGGMITKLRAARLAARSGTATVIASGRESGVLPRILDGEELGTLLIPDVSPLIARKRWMAGQLKLKGCFVVDEGAARVLRDAGKSLLPIGVIAVEGEFRRGDLVACTDSAGQEIARGLTNYSAEEARLIMRQPSTRIEEILGYVDEPELIHRDNLVLS

SEQ ID NO: 568 - DNA, 1119 bp, Methylobacillus flagellatus
  CDS (1)..(1119): transl_table=11
atgacgtcattgctattgaatgcaaaatgcctggtcgtgaaggtaggctccagtctggtgactaacaacggcgctggcctggataaaggtgccattgcagcctgggccgatcagattgcccggctggtgaagtcgggccggcaggtggtactggtatccagcggtgccgtggcggaaggcatgcagcgcctgggctggaagaagcggccagtggcgatcaacgagttgcaggctgctgcagccgttgggcaaatgggcttggtgcagatgtacgagtcctgctttgcttcccacggtttgcatactgcccagattctgctgacgcatgcagacttggccgacaggaaacgctacctgaatgcgcggacgacattgcgtaccttgctggacttgggcgtcattccgatcatcaatgaaaatgacacagttgtgaccgatgaaattcgcttcggtgacaatgacaccctgggatcgctggtagccaacctgatcgaagcggatgcgctggtgatcctcaccgaccagccgggcttgtattcggccgatccgcgcaagcatcccgatgcgcaattcattcagtatgaaactgctggcaatcctgctctggaaaagatggcaggtggcgccggcaccctgattgggagcggtggcatgctgaccaagatcctcgctgccaagcgggcagcgcgtagcggggcgcatactgtcatcgcctccggccgggagccggatatcttggtgaggctggcgcaaggcgaggtggtaggcacgcatctcaaggcgggccaggtcaagaccttggctcgcaagcaatggcttgcggatcaactgcgtgttgccggcaaggtcgtggtggatgaaggcgcagccaaggcattgcgcgaagggggacgcagcctgttgccgatcggcgtgatggctgtagaaggcagttttgagcgtggagaggtcgtatcctgtgtgaataccgcgggcgaggaaatcgcgcgcggattggtgaattacagtgcgctagagacggctcgcatcctgcgtcagccgagtcacgaaatagaacatatcctgggttatatcgatgggcctgaattgattcatcgcgacaacctgattctggtgtaa

SEQ ID NO: 569 - protein, 372 aa, Methylobacillus flagellatus
MTSLLLNAKCLVVKVGSSLVTNNGAGLDKGAIAAWADQIARLVKSGRQVVLVSSGAVAEGMQRLGWKKRPVAINELQAAAAVGQMGLVQMYESCFASHGLHTAQILLTHADLADRKRYLNARTTLRTLLDLGVIPIINENDTVVTDEIRFGDNDTLGSLVANLIEADALVILTDQPGLYSADPRKHPDAQFIQYETAGNPALEKMAGGAGTLIGSGGMLTKILAAKRAARSGAHTVIASGREPDILVRLAQGEVVGTHLKAGQVKTLARKQWLADQLRVAGKVVVDEGAAKALREGGRSLLPIGVMAVEGSFERGEVVSCVNTAGEEIARGLVNYSALETARILRQPSHEIEHILGYIDGPELIHRDNLILV

SEQ ID NO: 570 - DNA, 1137 bp, Moorella thermoacetica
  CDS (1)..(1137): transl_table=11
ttgacggaaagggagtgccggctggctttgagccaggcgcggcggctggtaataaaggtggggaccagtaccctgacccataaaacgggcaaactaaacctgggacggatggagcgtctggtgcgggagctggtggatcaggtcaacgccggccgccaggtggtcctggtaacctccggagccgtgggagccggtatgggccgcctgggtttgaaagaaaagccccggaccctgccggaaaaacaggccgctgccgccgtgggccaggggctgctcatgcatatgtacgaaaagttcttcagcgattacggcctgctggtagcccaggtgcttttgacccgggccgacctggccgaccgcagccgctacctaaattcccgccataccctggcggccctcctgcgcctgggagttgtacccattgtcaacgagaacgacaccgtagcggttgaggaaatccgcgtcggggataatgacaccctctccgccctggtggccgggctggtagacgcggatatcctgtttttactgactgataccggaggcctctttaccgccaacccggttaccagtgacgacgctgtcctgctcccctgcgtgacggagattacgccggagatagaagccctggccgggggggcgggttccacctggtcaacggggggcatggccactaagatccaggccgcccgcctggccaccagcttcggcatcccggtggtcatcgccagcggtctccaggccgggcaaatcgaagccgtcctgaagggtgaggaaataggcactattttcctgccccgggaacatcgggcccacaccaggaaacgctggctcgcctatgctccggccgtccaggggcaaatccaggttgacgccggggcagcccgggcaatatgtaaaaatggcaagagcctcctccccggtggcgttattgcggtggatggtgatttcgaccagggggctatagtaagtatcgttgatcccgctggtaaagagatcgcccggggtatggccaactatccggcagcggctatttctcggattaaaggcaggaaaacgggcgagattggcgaaatcttaggctataaggattacgacgagattgttcaccgggacaatctaattgtcctggggtag

SEQ ID NO: 571 - protein, 378 aa, Moorella thermoacetica
MTERECRLALSQARRLVIKVGTSTLTHKTGKLNLGRMERLVRELVDQVNAGRQVVLVTSGAVGAGMGRLGLKEKPRTLPEKQAAAAVGQGLLMHMYEKFFSDYGLLVAQVLLTRADLADRSRYLNSRHTLAALLRLGVVPIVNENDTVAVEEIRVGDNDTLSALVAGLVDADILFLLTDTGGLFTANPVTSDDAVLLPCVTEITPEIEALAGGAGSTWSTGGMATKIQAARLATSFGIPVVIASGLQAGQIEAVLKGEEIGTIFLPREHRAHTRKRWLAYAPAVQGQIQVDAGAARAICKNGKSLLPGGVIAVDGDFDQGAIVSIVDPAGKEIARGMANYPAAAISRIKGRKTGEIGEILGYKDYDEIVHRDNLIVLG

SEQ ID NO: 572 - DNA, 1134 bp, Myxococcus xanthus
  CDS (1)..(1134): transl_table=11
gtgagttcgatttccacgggacgcaccgccctacgctccgcccggcgggtggtggtgaaaatcggcaccaacgcgctgacgaacgccaccggacgtttcaaccgtcagcacttcgatgcgctgggccaggatttgttgtgggccgcgcagggccgcgagctggtggtggtgtccagcggggccattgccctgggggtcgagcggctgggcctgccctcgcgccctcgcgacatcccgggcaagcaggcgtgcgcggcggtggggcagagccggctggtgcaggcctacgaagaggccttcgccgcgcatgggaaggcggtggcccaggtgctgctcacccacgaggacgtgcaggagcgccgccgctacctcaacgtgaagcacaccctggagcggttgctgacggcgggcgtcgtccccgtcatcaacgagaacgacaccgtctccgtggacgagctgaagttcggtgacaacgacacgctggcggggctggtggccggcgtggtggatgccgacgcgctcgtcctgctgtcggatgtggagggcctctacaccggagacccccggcgcgacgcaggcgcggagctgctggccacggtgatgcaggtgacgcccgaggtcctggcgctcgccaccggtacgagcagcggggtggggacgggcgggatgagcaccaaggtgcgggcggccgcgcgcgcgtccgattccggcattcactgcgtgattacgtccggcgccgtgcccggccgcctgcgcgccgtcctggaaggcgcggacgtggggacccacttcgaacccaccggcagccgccgcagtgcccgcgccgcgtggattgcccatgccctgcgcgcacgcgggacgctcacggtggatgccggcgcgcgcgaggccattgtcaccggcaagcgcagcctgctgcccagcggcgttcgcggcgtggagggggacttcgggcgcggagacccggtggacctggtggacgcggagggggccgtgttcgcgcgggggctggcggcctacgacgccaacgagctgcgacgcatcgccggacatcgcacggcggacatcgaagcggtgctgggctaccgctacctcgacgaggccgtgcaccgcgacgacctggccgtgctgtag

SEQ ID NO: 573 - protein, 377 aa, Myxococcus xanthus
MSSISTGRTALRSARRVVVKIGTNALTNATGRFNRQHFDALGQDLLWAAQGRELVVVSSGAIALGVERLGLPSRPRDIPGKQACAAVGQSRLVQAYEEAFAAHGKAVAQVLLTHEDVQERRRYLNVKHTLERLLTAGVVPVINENDTVSVDELKFGDNDTLAGLVAGVVDADALVLLSDVEGLYTGDPRRDAGAELLATVMQVTPEVLALATGTSSGVGTGGMSTKVRAAARASDSGIHCVITSGAVPGRLRAVLEGADVGTHFEPTGSRRSARAAWIAHALRARGTLTVDAGAREAIVTGKRSLLPSGVRGVEGDFGRGDPVDLVDAEGAVFARGLAAYDANELRRIAGHRTADIEAVLGYRYLDEAVHRDDLAVL

SEQ ID NO: 574 - DNA, 1134 bp, Novosphingobium aromaticivorans
  CDS (1)..(1134): transl_table=11
atgaagatcagccagcttgcccaactgacccaggcttccacctgtccgcgcctcgtggtcaaggtcgggtcggccctgcttgtcggcaaggatggcgagccgcgccgcgaatggctttctgccctggtgtccgagatcgccgccatgcgcgcggccggacaggaagtcatcgtcgtctcctccggcgcgatcgcgctcggtgcgcgcaagctcgggcttgccaagggcgggcggggcagcctctccgacgcccaggccgccgcctcggtgggccagatcgcgctcgcggggctctgggccgaacttctggcgcagcacgggctcaccgccgcgcagatcctgctgacgctcgaagatctcgaggatcgccgacgttacctcaatgtcaccgccacgctgggcacgctgctcgcggcatgcgcggtgccggtgatcaacgagaacgattccgtcgcaacccaggaaatccgtttcggagacaacgaccgccttgccgcccgtgtgggccaggccgcaggcgcatcgggtgtgctgctcctgtccgacatcgacggtctctacgatcgcgacccccgccagcccggcgccacccgcattcccgtggtcaagggcgtgacccctgaaatccacgccatggccactggcggttcgtcttccggactcggctcgggcggcatgacgtccaagctccaggccgccgaaattgccgagcttgccggaatggcgcttgccatcatcgacggacagcccgttgccccgatcgccgctgccatgggcgctgcgcgcggcaccctgttcctgccacgcggacgcaagcaggcgcgcaaggcctggctcggcgggcgaatgcggatgcgcggcagcgtgcaggtcgacgccggtgccgccgccgcgctggcccgtggctccagcctgcttgccgccggagtgacagaggtcgacggcgatttccagcgcggcgatgccattgccgtgctcggtcccgacggccggacgctggcgcgcggcctttcggaatacgacgctgccgagtgcgcgcgcctcaaggggcgccacagccgcgagcatgaagaacttctgggctatgcgccgcgctcggcattgatccatcgcgaccagatggtgctgctgtaa

SEQ ID NO: 575 - protein, 377 aa, Novosphingobium aromaticivorans
MKISQLAQLTQASTCPRLVVKVGSALLVGKDGEPRREWLSALVSEIAAMRAAGQEVIVVSSGAIALGARKLGLAKGGRGSLSDAQAAASVGQIALAGLWAELLAQHGLTAAQILLTLEDLEDRRRYLNVTATLGTLLAACAVPVINENDSVATQEIRFGDNDRLAARVGQAAGASGVLLLSDIDGLYDRDPRQPGATRIPVVKGVTPEIHAMATGGSSSGLGSGGMTSKLQAAEIAELAGMALAIIDGQPVAPIAAAMGAARGTLFLPRGRKQARKAWLGGRMRMRGSVQVDAGAAAALARGSSLLAAGVTEVDGDFQRGDAIAVLGPDGRTLARGLSEYDAAECARLKGRHSREHEELLGYAPRSALIHRDQMVLL

SEQ ID NO: 576 - DNA, 1104 bp, Pasteurella multocida
  CDS (1)..(1104): transl_table=11
atgaaaatcgacaaaacactcgttgtgaaatttggaaccagtacgcttacgcaaggatcggcgaagttaaatttacctcatatgatggatattgtgcgtcagctcgcacagcttcatcaagcgggctttcgtttagtgattgtcacctcaggggcgattgcggcaggtcgtcattatttaaatcacccgcaattgccgccgacgattgcctcgaaacaattattggctgcggtaggacaaagtcagctcattcaaacgtgggaaaaattgtttgccatttatgatattcatattgggcagattttattgacccgtgccgacattgaagatcgtgaacgttttttaaatgccagagatactttgcgcgccttattagataatcagattattccagtgattaatgaaaatgacgctgtcgctacgtcagaaattaaagtaggcgataacgataatttatccgcgttagtggcgattttagtgcaagcagaacagttgtatttgcttactgatcagcaaggtttgtttgatcgtgatccgcgcaaacatccagacgccaaattgatcgccgacgtggacaaaattaccgatcatattcgcgcgattgcgggcggaagtggcacctcgttaggcacaggcggcatgtccaccaaaatcagtgccgcggatgtggcaacccgctccggcattgaaactattattgcaccgggtaatcgcccgaatgtgattgtggacttagcttatgggcaagccattggcaccaaatttagtgtgcaagcagatcgcttagaaagtcgtaaacaatggctatatgcggcgccgtcagccggtattattaccattgatgcgggggcggaaaacgcgatgttaatgcaacataaatcgttattgcctgctgggattgtgaacgtggaaggacgcttttcacgcggtgaagtggtaaaaattcgtactcagcaaggtaaggatgtcgccttagggatgccacgttataacagcgatgcactccatttaattcaaggcaaacattcgcaagatatcgaacaggttctcggttatgaatatggggcggttgcggtacaccgcgacgatatgattgtgttataa

SEQ ID NO: 577 - protein, 367 aa, Pasteurella multocida
MKIDKTLVVKFGTSTLTQGSAKLNLPHMMDIVRQLAQLHQAGFRLVIVTSGAIAAGRHYLNHPQLPPTIASKQLLAAVGQSQLIQTWEKLFAIYDIHIGQILLTRADIEDRERFLNARDTLRALLDNQIIPVINENDAVATSEIKVGDNDNLSALVAILVQAEQLYLLTDQQGLFDRDPRKHPDAKLIADVDKITDHIRAIAGGSGTSLGTGGMSTKISAADVATRSGIETIIAPGNRPNVIVDLAYGQAIGTKFSVQADRLESRKQWLYAAPSAGIITIDAGAENAMLMQHKSLLPAGIVNVEGRFSRGEVVKIRTQQGKDVALGMPRYNSDALHLIQGKHSQDIEQVLGYEYGAVAVHRDDMIVL

SEQ ID NO: 578 - DNA, 1107 bp, Photorhabdus luminescens subsp
  CDS (1)..(1107): transl_table=11
atgatgaatagcagccaaacattggttgtgaaactggggacgagtgtactgacaggcggctctcgtcgcctgaatcgagctcatattgtagaactggtaaggcaatgtgctcagcaacatgaaaaaggtcatcgcattattattgtgacttccggtgctattgcggcagggagggaacatttgggctatccggatctacctgcaacaattgcatccaagcaattgctggcggcggtcggccaaagtcggttgattcagttatgggagcagtttttttctatttatggtatccatgttgggcaaatgttattgacccgggcggatttagaagatcgcgaacgttttttaaatgccagagatactttacaggctttgcttgataatcgcattgtgcctgtcattaatgagaatgatgcggttgcgacggcggaaataaaagtgggtgataatgataatttatctgcactagcggcaattctggggggcgccgataaattgctattgctgacggatattgaagggctgtataccgctgatccgcgtaacaatccagacgcaaaacttatcccggaagtttatgacatcagcgatgaattacgtatggttgccggtgatagcatttcgggtttagggacgggaggcatggcaactaaacttcaggcggcggggattgctggtcgcgcggggattgatgtcattattgccgcgggtaataaacccgatgtcatctctgatgtcattgaaggtaatccggtaggtactcgttttcatgggttggaaagcccgatggaaaatcgcaagcgttggatttttggcgcacctccggcgggtgaaattattgtagatcatggcgctgaaacagcaatctgcgaaaaaggcagctctttattaccgaaagggattaaaaatattaaaggtgatttctcccgtggagaggttatctgtattcgtagtctgtctggtaaagatttggcgcatggtgtttgccgttataacagtgatgctctacgtttaattgcaggccaccattcacaacagataagccaaatcctcggttatgaatatggtgctgttgcggttcatcgtgatgacatgatcgtgagttaa

SEQ ID NO: 579 - protein, 368 aa, Photorhabdus luminescens subsp
MMNSSQTLVVKLGTSVLTGGSRRLNRAHIVELVRQCAQQHEKGHRIIIVTSGAIAAGREHLGYPDLPATIASKQLLAAVGQSRLIQLWEQFFSIYGIHVGQMLLTRADLEDRERFLNARDTLQALLDNRIVPVINENDAVATAEIKVGDNDNLSALAAILGGADKLLLLTDIEGLYTADPRNNPDAKLIPEVYDISDELRMVAGDSISGLGTGGMATKLQAAGIAGRAGIDVIIAAGNKPDVISDVIEGNPVGTRFHGLESPMENRKRWIFGAPPAGEIIVDHGAETAICEKGSSLLPKGIKNIKGDFSRGEVICIRSLSGKDLAHGVCRYNSDALRLIAGHHSQQISQILGYEYGAVAVHRDDMIVS

SEQ ID NO: 580 - DNA, 1137 bp, Photobacterium profundum
  CDS (1)..(1137): transl_table=11
atgacaccacctttatcggataaacaaacgctcccccccaagcaaaccattgttgtaaagcttggtaccagtgtattaacgggtggtactttgaagctagatcgtgctcatatggttgagttggttcgccaatgtgcttatcttcgacgttatggtcataaagtgattattgtgacatcgggtgcgattgcagctggtcgagagcatttagactaccctgaattgccgaaaacaatggctagcaaacagttacttgcggctgtaggtcaaagtcgtttgattcaagagtgggaaagcctgtttggcatttatggtcttcatgtcggtcagatgctgctaacgcgtgctgatcttgacgatcgtgaacgttacttgaatgctcgagacatgctcattgcgttattagataacggcattattcctgttgtaaatgaaaatgatgcggttgctaccactgaaataaaagtgggcgataatgataatttatccgctctagtgggtattttaggcggtgcagataagctactgctattaaccgaccaacccggtttatttactgctgatccacgtaataacccagatgcagagcttattcgcgaagtacataccattgatgaaacactgcgcaaattagcaggtggcagtgcaggtggtttaggtactggtggtatggcgactaaattgcaagcagcagatgttgctcgtcgtgcgggtattgaagtaattattgcagcgggtagtcgccccgatgtgatttctgatttagccagtggtgagtcggtaggaacacgctttcttccgttagatacaccactagaaagtcgtaagcgttggattttagcgggtccccctcctgctggtgatattgtgattgatgctggtgccgctaaggccgtactggaaagaggcagtagcttactatcgaaaggtattagcgaagtaaaaggggcatttgaacgtggcgaagtcgcacgcattttcgataccaacggtgttttgttagcccgcggtatttgtcgctattcaagccgcgatatggcaatgattgtaggtaagcacagccaagaaatttataaagtgctgggttatgaatatggtcctgttgctattcaccgtgatgatctagtggttatttaa

SEQ ID NO: 581 - protein, 378 aa, Photobacterium profundum
MTPPLSDKQTLPPKQTIVVKLGTSVLTGGTLKLDRAHMVELVRQCAYLRRYGHKVIIVTSGAIAAGREHLDYPELPKTMASKQLLAAVGQSRLIQEWESLFGIYGLHVGQMLLTRADLDDRERYLNARDMLIALLDNGIIPVVNENDAVATTEIKVGDNDNLSALVGILGGADKLLLLTDQPGLFTADPRNNPDAELIREVHTIDETLRKLAGGSAGGLGTGGMATKLQAADVARRAGIEVIIAAGSRPDVISDLASGESVGTRFLPLDTPLESRKRWILAGPPPAGDIVIDAGAAKAVLERGSSLLSKGISEVKGAFERGEVARIFDTNGVLLARGICRYSSRDMAMIVGKHSQEIYKVLGYEYGPVAIHRDDLVVI

SEQ ID NO: 582 - DNA, 1086 bp, Prochlorococcus marinus
  CDS (1)..(1086): transl_table=11
atgagtctgtgggtggtgaaggtgggaaccagcctgctgagaggcaatgagaagcaatccaccgccgaagtgattgagagctacagcgcctgcctttcagcaagcctcaagcggggggatcatgttgtcctcgtaacaagtggcgccgtaggtcttggttgtaatcgtctagggctaagccaacggccggtcgatgtggtggctctccaagggacggcggcgatcggtcaaggacaactcatggctctttatgaggctgccatgagccgaaggggtcacaccgtggctcaggtattgcttacccgctcagatcttggctccaggcagcgataccgcaatgcttctagcaccttgaagcaattgctcgactggggcgttctgccggtggtgaatgagaacgacgccctctctccggaagaattgcgatacggcgacaacgacaccctttcagctctcgttgcaaccgcagtggaggctgatcagctcatcatgctcaccgacgtggatcgcctttattcctcagacccccgcattaatgcctctgccgaaccgatctcagatgtttaccatccccatgaactgactgccctggaagtcgcggcaggggagggaggtgcctggggcactgggggcatgactacaaaacttgcggcagctcgcatcgctaccgcaagtggcatcaccgttcttcttgctgatggccgcgatcctcaagtgcttgatgggttgctgcaaggaagacggagcggcacggtgtttcatcctcaccctcaacctctcggcaatcgcaagagctggctggcccatgctctgaagcccttagggacccttcagctggatgaaggcgcctgcgatgcccttcaacatcgtggcgcctccctgctcttggtgggggttaaagaggtggaaggaaactttgaagccaaccagccggtaagactaattaatcccgaaggtaacgagctcgctcgaggcctgtgttccttgagtagcaaagaactgcgcgaggccattgagacccaaatgagcacgaatcgttcaccggtcgtggtgcatagggacgtgttggttctccgcaacgcgtga

SEQ ID NO: 583 - protein, 361 aa, Prochlorococcus marinus
MSLWVVKVGTSLLRGNEKQSTAEVIESYSACLSASLKRGDHVVLVTSGAVGLGCNRLGLSQRPVDVVALQGTAAIGQGQLMALYEAAMSRRGHTVAQVLLTRSDLGSRQRYRNASSTLKQLLDWGVLPVVNENDALSPEELRYGDNDTLSALVATAVEADQLIMLTDVDRLYSSDPRINASAEPISDVYHPHELTALEVAAGEGGAWGTGGMTTKLAAARIATASGITVLLADGRDPQVLDGLLQGRRSGTVFHPHPQPLGNRKSWLAHALKPLGTLQLDEGACDALQHRGASLLLVGVKEVEGNFEANQPVRLINPEGNELARGLCSLSSKELREAIETQMSTNRSPVVVHRDVLVLRNA

SEQ ID NO: 584 - DNA, 1107 bp, Pseudomonas syringae pv
  CDS (1)..(1107): transl_table=11
gtgacgggcgcccagcgctgggttgtgaagattggcagtgccttgctgaccgcggatggcaagggcctggatcgcaacgccatgggtgtttgggtggagcagatggcggcgctgcatgaggcgggtgtcgagctggtgctggtgtcttccggggcggtggctgccggtatgagccgtcttggctggacggcccgacccagcgccatgcatgagctccaggctgctgcggccatcggtcagatgggcttggtgcaggcgtgggaatcgagttttgccgagcacggccggcataccgcgcaaattctgctgacccatgacgacctgtcggaccgcaagcgctacctcaatgcccgcagtaccctgcgcacgctggtcgagcttggggttgtgccggtcatcaacgaaaatgacacagtggtcaccgacgaaatccgttttggcgataacgacacgctggcggcgctggttgccaatctggtcgaggcagatctgttggtcatcctgactgaccgcgacggcatgttcgacgctgatccgcgcaacaacccggaggctcagctgatctacgaagcgcgcgccgatgaccctgcgctggatgctgtggctggtggtacaggtggcgcactggggcgcggtggtatgcagaccaagttacgcgctgcgcggttggcggcgcgttccggtgcgcataccgtcattgtcggtgggcgtatagagcgcgtgctggcgcggctcaagggtggcgaacgtttggggacattgctgtctcccgagcgcggcatgctcgcggcgcgcaagcagtggctggcagggcacctgcaaactcgcggcacgctggtgctggatgatggcgctgttgcggcgctggccaaggatcagaaaagcctgctaccggtgggtgtcaagctggtccagggcagcttccggcgtggcgagatggtggtatgcgttgcctcggacggtcgcgagatcgctcgcgggctgagcaactacagtgctatcgaagcccagaaaatcattggtcactcttccgaatccatcgtgcgcgagctgggatatatggccgagcctgagctgattcatcgggataacctgatcctcgtctga

SEQ ID NO: 585 - protein, 368 aa, Pseudomonas syringae pv
MTGAQRWVVKIGSALLTADGKGLDRNAMGVWVEQMAALHEAGVELVLVSSGAVAAGMSRLGWTARPSAMHELQAAAAIGQMGLVQAWESSFAEHGRHTAQILLTHDDLSDRKRYLNARSTLRTLVELGVVPVINENDTVVTDEIRFGDNDTLAALVANLVEADLLVILTDRDGMFDADPRNNPEAQLIYEARADDPALDAVAGGTGGALGRGGMQTKLRAARLAARSGAHTVIVGGRIERVLARLKGGERLGTLLSPERGMLAARKQWLAGHLQTRGTLVLDDGAVAALAKDQKSLLPVGVKLVQGSFRRGEMVVCVASDGREIARGLSNYSAIEAQKIIGHSSESIVRELGYMAEPELIHRDNLILV

SEQ ID NO: 586 - DNA, 1119 bp, Pseudomonas aeruginosa
  CDS (1)..(1119): transl_table=11
atgcgggacaaggtgactggcgcgcggcgctgggtggtgaagatcggtagcgccctgctgacggccgatggccgtgggctggatcgcaatgccatggccgtttgggtcgagcagatggtggcgctgcattgcgccggcatcgagctggtgctggtgtcgtccggcgccgtcgccgccggtatgagccgcctgggctgggtgtcccgacctagcgcgatgcacgaactccaggccgccgcctcggtggggcaaatggggttggtgcaggcctgggagtccagcttcgccctgcatggcctgcagaccgcccaggtgttgctgacccatgacgacctctccgaccgcaagcgctacctgaacgcccgcagcaccctgcggaccctggtcgagctgggcgtggtcccggtgatcaacgagaacgacacggtggtcaccgacgagatccgcttcggcgacaacgacaccctggcggcactggtggccaacctggtcgaggccgacctgctggtgatccttaccgatcgcgacgggatgttcgacgccgatccgcgcaacaatcccgatgcccaactgatctacgaggcgcgtgccgatgatccgcagctcgatgcggtggccggcggcagtgccggcgccctggggcgcggcggaatgcagaccaagctgcgggcggcgcgcctggcggcgcgttccggcgggcatacggtgatcgtcggcgggcgtatcgagcgtgtcctcgaccgcctgcgcgccggcgaacgcctcggcaccctgttgacccctgatcgcagtcgcaaggcggcgcgcaagcaatggctggccggccacttgcagatgcgcggcaccctggtgctggacgatggggcggtgaaggcggtgagccaggatcacaagagcctgttgccggttggggtcaaggcggtccagggcagcttccgtcgcggcgagatggtggtctgtgtggaccagggcgggcgcgaagtggcacgcggcctggtcaactacagtgcgctggaggcgcagaagatcctcggtcagccgacggatgccatcgaggccttgctcggctacgtggatgggccggagctggtgcatcgcgacaatttggttctggtctga

SEQ ID NO: 587 - protein, 372 aa, Pseudomonas aeruginosa
MRDKVTGARRWVVKIGSALLTADGRGLDRNAMAVWVEQMVALHCAGIELVLVSSGAVAAGMSRLGWVSRPSAMHELQAAASVGQMGLVQAWESSFALHGLQTAQVLLTHDDLSDRKRYLNARSTLRTLVELGVVPVINENDTVVTDEIRFGDNDTLAALVANLVEADLLVILTDRDGMFDADPRNNPDAQLIYEARADDPQLDAVAGGSAGALGRGGMQTKLRAARLAARSGGHTVIVGGRIERVLDRLRAGERLGTLLTPDRSRKAARKQWLAGHLQMRGTLVLDDGAVKAVSQDHKSLLPVGVKAVQGSFRRGEMVVCVDQGGREVARGLVNYSALEAQKILGQPTDAIEALLGYVDGPELVHRDNLVLV

SEQ ID NO: 588 - DNA, 1107 bp, Pseudomonas fluorescens
  CDS (1)..(1107): transl_table=11
gtgacaggtgcgcagcgctgggtcgttaagatcggcagtgcgctgctgacggcggacggcaaggggctggatcgcacggcaatgggtgtgtgggtggagcagatggtggccttgcatgaggccggcgtcgagctggtactggtttcctccggtgctgtagcggccggcatgagccgcctgggctggaccgcacgaccgagtgcgatgcatgagttgcaggccgctgcggccatcggccagatggggctggtgcaggcctgggagtcgagctttgccgagcatggccggcatactgcacagattctcctgacccatgacgacctctccgatcgcaagcgctacctcaatgctcgcagtaccttgcgtgccctggtggagctcaaggtgatcccggtgatcaacgagaacgacactgtggtgaccgacgagatccgctttggcgacaacgatactctggcggcgctggtggccaacctggttgaggctgatctgctggtgattcttaccgaccgtgacggcatgttcgatgccgacccgcgtaacaatcctgatgcccagctgatctatgaggcgcgggccgacgacccggcgctggatgcggtggccggtggtacgggcggtgcgctggggcgtggcggcatgcagaccaagttgcgtgcggcgcggctggctgcgcgttccggggcgcatacaatcatcgttggtgggcgtctggatcgcgtgctggaccgcctcaaggctggcgagcgcatcggcaccttgctgtcgccggagcgcggcatgctggcggcgcgcaagcagtggctggccgggcatctgcagacccgcggcaccctggtgctggatgagggggcggtgtcggctctgtcccagggtaacaagagcctgttgccggtgggggtcaagcaggtccagggtggtttccggcgtggtgagatggtggtgtgcgtagcgccggatggtcgtgaaattgctcgtggcctggccaactacagtgcgcttgaggcgcagaagatcattggtcagccgtccgacgctattgtcggtgtcctggggtatatggcggagcctgaactggtacaccgcgataacctgattctggtgtaa

SEQ ID NO: 589 - protein, 368 aa, Pseudomonas fluorescens
MTGAQRWVVKIGSALLTADGKGLDRTAMGVWVEQMVALHEAGVELVLVSSGAVAAGMSRLGWTARPSAMHELQAAAAIGQMGLVQAWESSFAEHGRHTAQILLTHDDLSDRKRYLNARSTLRALVELKVIPVINENDTVVTDEIRFGDNDTLAALVANLVEADLLVILTDRDGMFDADPRNNPDAQLIYEARADDPALDAVAGGTGGALGRGGMQTKLRAARLAARSGAHTIIVGGRLDRVLDRLKAGERIGTLLSPERGMLAARKQWLAGHLQTRGTLVLDEGAVSALSQGNKSLLPVGVKQVQGGFRRGEMVVCVAPDGREIARGLANYSALEAQKIIGQPSDAIVGVLGYMAEPELVHRDNLILV

SEQ ID NO: 590 - DNA, 1119 bp, Pseudomonas fluorescens
  CDS (1)..(1119): transl_table=11
atgcggagcaaggtgacaggtgcgcagcgttgggtcgtgaagatcggcagcgctttgctgacagcggatggcaaagggctggatcgcacggcaatgggtgtctgggtcgagcagatggtggctctgcatgaggctggcgtcgagctggtgctggtgtcctccggggcggtggcggcaggcatgagtcgcctgggctggactgcgcgacccagtgcgatgcatgagctccaggctgccgctgcaatcggtcagatgggtctggtgcaagcctgggaatcgagctttgccgagcatggccggcacaccgcgcagattcttctgactcacgacgacctgtccgatcgcaagcgttacctgaacgcccgcagcaccttgcgtgcgctggtcgagctgaaagtcatcccagtgatcaacgagaacgacaccgtggtcactgacgaaatccgcttcggcgacaacgacacgctcgcggcgctggtggccaacctggtcgaggctgatctgctggtgatcctgacggatcgcgacggcatgttcgacgccgatccgcgcagtaaccctgacgcccaactgatttacgaagcgcgcgccgatgatccgacactggatgcggtggcgggcggtactggcggtgcattgggtcgtggcggcatgcagaccaagctgcgcgcggcgcggctggcggcacgttccggggcgcataccatcattgttggtgggcgtctggagcgcgtgcttgatcgtctgaaggcgggcgagcgcatcggtacgctgctgtcgcctgagcgcggcatgctcgcggcgcgcaagcagtggctggccgggcatctgcaaacccgtggcacgctggtgctggatgatggcgcggtttctgcgttgtcccagggcaacaaaagtctgctgccggtcggcgtcaaactggttcagggcagtttccgtcgcggcgaaatggtggtttgcgtggcgccggacggtcgtgagatcgcccgcggcctggcgaactacagtgctctggaagcacaaaaaatcatcggtcagtcgtcagatgcgattgtcggtttgctgggttacatggctgagccggaactggttcatcgtgacaacctgattctggtgtaa

SEQ ID NO: 591 - protein, 372 aa, Pseudomonas fluorescens
MRSKVTGAQRWVVKIGSALLTADGKGLDRTAMGVWVEQMVALHEAGVELVLVSSGAVAAGMSRLGWTARPSAMHELQAAAAIGQMGLVQAWESSFAEHGRHTAQILLTHDDLSDRKRYLNARSTLRALVELKVIPVINENDTVVTDEIRFGDNDTLAALVANLVEADLLVILTDRDGMFDADPRSNPDAQLIYEARADDPTLDAVAGGTGGALGRGGMQTKLRAARLAARSGAHTIIVGGRLERVLDRLKAGERIGTLLSPERGMLAARKQWLAGHLQTRGTLVLDDGAVSALSQGNKSLLPVGVKLVQGSFRRGEMVVCVAPDGREIARGLANYSALEAQKIIGQSSDAIVGLLGYMAEPELVHRDNLILV

SEQ ID NO: 592 - DNA, 1119 bp, Pseudomonas putida
  CDS (1)..(1119): transl_table=11
atgcgaagcaaggtgacgggcgccaagcgctgggtcgttaagattggcagtgctctgctgaccgccgatggcaagggcctcgaccgcggtgcaatggccgtttgggtcgagcagatggtcgcgctgcgtgaggcgggcgtggagttggtactggtctcctccggggccgtggctgccggcatgagccagctgggctggaccaagcgaccgagtgcgatgaacgagctgcaggcggctgcctcgctcggccagatgcgtctggtgcaggcctgggagtcgagcttcggggagcacgggaagcacaccgcgcagatcctgctgacccatgacgacctgtccgaccgcaagcgttacctgaatgcccgcagcaccctgcgcaccttggtcgatctgggcgtggtgccggtgatcaacgaaaacgacaccgtggtcaccgacgagatccgcttcggcgacaacgacaccctggcggcgctggtggccaacctggtcgaggccgacctgctggtgatcctcaccgaccgcgatggtatgttcgatgccgacccgcgcaacaaccccgaagcgcagttgatctacgaagcccgcgccgacgacccctcactggatgccgtggccggtggtaccggtggtgccctgggccgtggcggcatgcagaccaagctgcgtgcggcgcgcctggctgcccgttccggcgcccacaccatcattatcggtggccgcatcgagcgcgtgctggaccgcctgaaggcgggcgagcgcctgggcaccttgctgtcccctgagcgcggcatgctcgcggcgcgcaagcagtggctggccggtcacctgcaaacccgtggcaccctggtgctggatgccggtgccgtgcaagcgctgcgtcaggccaacaagagcttgctgccggttggcgtgaagactgtgcagggcagcttccgtcgcggcgagatggtggtgtgcgtcggcccggacggtgttgaagtggctcgcggcctggccaactacagcgccctggaggcgcagaagatcattggtcagtcgtccgaagccatcgagtcgatccttggctatagcgccgagccggaacttgtacaccgcgacaacctggtgctggtatga

SEQ ID NO: 593 - protein, 372 aa, Pseudomonas putida
MRSKVTGAKRWVVKIGSALLTADGKGLDRGAMAVWVEQMVALREAGVELVLVSSGAVAAGMSQLGWTKRPSAMNELQAAASLGQMRLVQAWESSFGEHGKHTAQILLTHDDLSDRKRYLNARSTLRTLVDLGVVPVINENDTVVTDEIRFGDNDTLAALVANLVEADLLVILTDRDGMFDADPRNNPEAQLIYEARADDPSLDAVAGGTGGALGRGGMQTKLRAARLAARSGAHTIIIGGRIERVLDRLKAGERLGTLLSPERGMLAARKQWLAGHLQTRGTLVLDAGAVQALRQANKSLLPVGVKTVQGSFRRGEMVVCVGPDGVEVARGLANYSALEAQKIIGQSSEAIESILGYSAEPELVHRDNLVLV

SEQ ID NO: 594 - DNA, 1119 bp, Pseudomonas syringae pv
  CDS (1)..(1119): transl_table=11
atgcgcagcaaagtgacgggcgcccagcgctgggttgtgaagattggcagtgccttgctgaccgcggatggcaagggcctggatcgcaacgccatgggtgtgtgggtagagcagatggtggcgctgcatgaagcaggcgtcgagctggtgctggtttcttccggggctgttgctgccggtatgagtcgccttggctggacggcgcgacccagtgcaatgcacgagcttcaggctgccgctgcaatcggtcagatggggctggtgcaggcgtgggagtcgagttttgccgagcatggccggcataccgcgcagatcctgctgacccacgacgacctgtcggaccgcaaacgctacctgaatgcccgtagcaccctgcgtacgctggtcgagcttggggtggtgccggtcatcaacgaaaacgacacagtggtcaccgacgagatccgttttggcgacaacgacacactggcggcgctggttgccaacctggtcgaggccgatctgctggtcatcctgactgatcgtgatggcatgttcgacgctgatccgcgcaacaaccctgatgcgcagctgatttacgaagcgcgtgccgatgatccggcgctggatgcggtagcgggcggtacgggcggtgcgctggggcgtggcggcatgcagaccaaattgcgtgctgcgcgcctggctgcgcgttccggtgcgcataccgtgatcgtcggcgggcgcatcgagcgcgtgctggcgcggctcaaggggggcgaacggctgggaacattgctgtcgcccgagcgcgaaatgctcgcggcgcgcaagcaatggctggctggccacttgcagacccgcggtacgctggtgctggacgacggcgcggtttcggcgctggccagcgatcacaaaagcctgctgccggttggcgtcaagctggtgcagggcagcttccgtcgcggcgagatggtggtgtgtgtcgcgcctgacggtcgggagatcgctcgcgggttgagtaactacagtgccatcgaggcgcagaagatcattggtcactcatccgaggccatcgtgcgcgagctgggctatatggccgagccggagctgattcatcgggataatctgattcttgtctga

SEQ ID NO: 595 - protein, 372 aa, Pseudomonas syringae pv
MRSKVTGAQRWVVKIGSALLTADGKGLDRNAMGVWVEQMVALHEAGVELVLVSSGAVAAGMSRLGWTARPSAMHELQAAAAIGQMGLVQAWESSFAEHGRHTAQILLTHDDLSDRKRYLNARSTLRTLVELGVVPVINENDTVVTDEIRFGDNDTLAALVANLVEADLLVILTDRDGMFDADPRNNPDAQLIYEARADDPALDAVAGGTGGALGRGGMQTKLRAARLAARSGAHTVIVGGRIERVLARLKGGERLGTLLSPEREMLAARKQWLAGHLQTRGTLVLDDGAVSALASDHKSLLPVGVKLVQGSFRRGEMVVCVAPDGREIARGLSNYSAIEAQKIIGHSSEAIVRELGYMAEPELIHRDNLILV

SEQ ID NO: 596 - DNA, 1119 bp, Pseudomonas syringae pv
  CDS (1)..(1119): transl_table=11
atgcgcagcaaagtgacgggcgcccagcgctgggttgtgaagattggcagtgccttgctgacggcggatggcaagggtctggatcgcaacgccatgggtgtttgggtggagcagatggtggcgctgcacgaggcgggtgtcgagctggtactggtgtcttccggggcggtggctgccggcatgagccgtcttggctggacggcccgacccagcgccatgcatgagctccaggctgctgcggcgattggtcagatgggcttggtgcaggcgtgggagtcgagcttcgccgagcatggccgacataccgcgcagatccttctgactcacgatgacctgtcggaccgcaagcgctacctgaatgcccgtagcaccctgcgcacgctggtcgagcttggggttgtgccggtcatcaatgaaaacgacacagtggtcaccgacgaaatccgttttggcgataacgacacgctggcggcgttggttgccaatctggtcgaggctgatctgctggtcatcctgaccgaccgtgacggcatgttcgacgctgatccgcgcaacaacccggaggcgcagctgatttacgaagcgcgtgccgatgatccggcgctggatgcagtggccggtggtaccggcggtgcgctgggtcgcggcggcatgcagaccaagttgcgtgcagcgcgactggcggcgcgttccggtgcgcataccgtcatcgtcggcgggcgcatcgagcgcgttctggcgcggctcaagggaggggagcggttgggtacgctgctgtccccggagcgcggcatgctcgcagcacgcaagcagtggctggcaggtcatctgcagacccgcggtacgctggtgctggatgatggcgctgttgcggcgctggccagggatcagaaaagcctgctgccggtgggcgtcaaactggtccagggcagcttccggcgcggcgagatggtggtatgcgtcgcccaggacggtcgcgagatcgctcgtgggctgagtaactacagtgccatcgaagcccagaaaatcattggtcactcttccgaatccatcgtgcgcgagctgggctatatggccgagcccgagctgattcatcgggataacctgatcctcgtctga

SEQ ID NO: 597 - protein, 372 aa, Pseudomonas syringae pv
MRSKVTGAQRWVVKIGSALLTADGKGLDRNAMGVWVEQMVALHEAGVELVLVSSGAVAAGMSRLGWTARPSAMHELQAAAAIGQMGLVQAWESSFAEHGRHTAQILLTHDDLSDRKRYLNARSTLRTLVELGVVPVINENDTVVTDEIRFGDNDTLAALVANLVEADLLVILTDRDGMFDADPRNNPEAQLIYEARADDPALDAVAGGTGGALGRGGMQTKLRAARLAARSGAHTVIVGGRIERVLARLKGGERLGTLLSPERGMLAARKQWLAGHLQTRGTLVLDDGAVAALARDQKSLLPVGVKLVQGSFRRGEMVVCVAQDGREIARGLSNYSAIEAQKIIGHSSESIVRELGYMAEPELIHRDNLILV

SEQ ID NO: 598 - DNA, 1119 bp, Ralstonia eutropha
  CDS (1)..(1119): transl_table=11
atgcaatcggtcattgcccaggcaaaacgtatcgtcgtcaaggttggctccagcctggtcaccaacgacggcaagggattggactacgacgccattgcgcgctgggcggcgcagatcgcaaagctgcgttcgatcggcaaggaagtggtgctggttagttccggcgccattgccgagggcatgcaacgcctgggctgggtacgccgaccgcgtgaaatccacgaactgcaagccgccgccgccgttggccagatgggcctggcgcaggtctacgaaagccagttcggccgctatggcatccgcaccgcgcaggtgctgctgacccacgccgatctggccgaccgcgaacgctacctgaacgcacgttccacgctgctcacgctgctgtctctcggcgtcgtgccgatcatcaacgagaacgacaccgtggttaccgacgaaatcaagttcggcgacaacgacacgcttggcgcgctggtcaccaacctgatcgaaggcgatgcgctggtcatcctgaccgaccagcgtgggctctacaccgctgatccgcgcaaggacccgaatgccgagttcgtcgacgaggcgctggccggcacgcccgagctggagcagatggcgggcggcgccggtacatcgatcggccggggcggcatgctgaccaagatcctcgcggccaagcgcgcggccaagtcaggcgcgcacacgaccattgcgtctggccgtgaggccaacgtgctcgaacgcctggcagccggtgaggccattggcacgcaactgctggcgccgaccggccgcctgaccgcgcgcaaacagtggatggcagatcacttgcagctgcgcggccgcgtggtcatcgacgccggcgccgtcgaaaagctgaccagcggcggcaagtcactgctgccgatcggcgtggtcgaagtgcagggcgagttcgcgcgcggcgaggtaattgcctgtgtcggcgcggacgggcgcgaagtggcgcgcggcatcaccaactattcgagcgccgaggcccgcctgattgcgcgcaagccgtcgtcggagatcgagtcggtgctcggccacctgaacgaacccgaactgatccaccgggacaacctcgtgctggtctga

SEQ ID NO: 599 - protein, 372 aa, Ralstonia eutropha
MQSVIAQAKRIVVKVGSSLVTNDGKGLDYDAIARWAAQIAKLRSIGKEVVLVSSGAIAEGMQRLGWVRRPREIHELQAAAAVGQMGLAQVYESQFGRYGIRTAQVLLTHADLADRERYLNARSTLLTLLSLGVVPIINENDTVVTDEIKFGDNDTLGALVTNLIEGDALVILTDQRGLYTADPRKDPNAEFVDEALAGTPELEQMAGGAGTSIGRGGMLTKILAAKRAAKSGAHTTIASGREANVLERLAAGEAIGTQLLAPTGRLTARKQWMADHLQLRGRVVIDAGAVEKLTSGGKSLLPIGVVEVQGEFARGEVIACVGADGREVARGITNYSSAEARLIARKPSSEIESVLGHLNEPELIHRDNLVLV

SEQ ID NO: 600 - DNA, 1119 bp, Ralstonia metallidurans
  CDS (1)..(1119): transl_table=11
atgcaatcggtcatcgcccaggcaaaacgcattgtcgtcaaagtaggttcgagtctggttaccaacgacggcaaggggctcgaccacgatgccatcgcgcgctgggcagctcagatcgccaagctgcgtggcacgggcaaggaagtcgtgctggttagctcaggcgcgattgccgaagggatgcagcgactgggctgggcgcgccggccgaaggaaatccacgaactgcaggccgctgccgcggtgggccagatgggcttggcgcaggtctacgaaagccagttcggccgatatggcatccgcaccgcgcaggtgctgctgacgcacgctgacctggccgatcgcgagcgctatctgaatgcccgttccacgctgctgacgctgctgtccctcggcgtggtgccgatcatcaacgagaacgacacggtcgtcaccgacgaaatcaagttcggcgacaacgatacgctcggcgcgctggtgacgaatttgatcgaaggcgacgcattggtgatcttgaccgaccagcgtgggctctacaccgctgatccgcgcaaggacccgaatgccgagttcgtccatgaagcgctggctggcacgcccgaactcgaggccatggccggtggcgcgggctcgtctattggccgaggcggcatgctgaccaagatcctggcggccaagcgggcggcgaagtctggtgctcatacgacgatcgcctcgggtcgcgaggccgatgtgctgggcaggctggctgccggcgaggccatcggcacgcaactgctggcgccgaccggtcgtctgacggcgcgcaagcagtggatggcggatcacctgcagttgcgcggccgcgtgatcatcgacgcgggcgctgtagagaagctcaccagcggtggcaagtcgctgctgccgattggcgtagtggaagtgcagggcgagttcgcccgtggcgaggtcattgcgtgcgccagcccggaggggaaggaagtggcgcgcggcatcaccaactattcgagcgccgaagcccgtctgatcgcacgcaagccgtcatcggagatcgagtcggtgctgggccatctgaacgagcccgagttgatccatcgcgacaaccttgtgctggtctga

SEQ ID NO: 601 - protein, 372 aa, Ralstonia metallidurans
MQSVIAQAKRIVVKVGSSLVTNDGKGLDHDAIARWAAQIAKLRGTGKEVVLVSSGAIAEGMQRLGWARRPKEIHELQAAAAVGQMGLAQVYESQFGRYGIRTAQVLLTHADLADRERYLNARSTLLTLLSLGVVPIINENDTVVTDEIKFGDNDTLGALVTNLIEGDALVILTDQRGLYTADPRKDPNAEFVHEALAGTPELEAMAGGAGSSIGRGGMLTKILAAKRAAKSGAHTTIASGREADVLGRLAAGEAIGTQLLAPTGRLTARKQWMADHLQLRGRVIIDAGAVEKLTSGGKSLLPIGVVEVQGEFARGEVIACASPEGKEVARGITNYSSAEARLIARKPSSEIESVLGHLNEPELIHRDNLVLV

SEQ ID NO: 602 - DNA, 1125 bp, Ralstonia solanacearum
  CDS (1)..(1125): transl_table=11
atggccctgcgttcgctgatcgccgatgcgcgccgcctcgtcgtcaaggtcggttccagcctggtcaccgatgacggccgcggcctcgaccaggccgccatcgcccgctgggccgcgcagatcgcggcgctgcgcgcggccggcaaggaggtcgtgctggtgagctccggcgccatcgccgaaggcatgcagcggctgggctggacccggcggccgaaggagatccacgagctgcaggccgctgccgccgtcggacagatgggcctggcccaggtgtacgaatcggagttcgcgcggcacggtatccgcacggcgcaggtgctgctgacgcatggcgatctggctgaccgcgagcgctacctgaacgcgcgctcgacgctgctgaccctgctgggcctcggcgtggtgccgatcatcaacgagaacgacacggtcgtcaccgacgagatcaagttcggcgacaacgatacgctgggcgcgctggtcaccaacctgatcgaaggcgatgcgctgatcatcctgacggatcagcgtggcctgtacaccgccgatccgcgcaagcaccccgatgcgcgcttcgtcgacgaagcccaggccggggcgccggagctggaggccatggctggcggtgccggcagcagcatcggcaagggcggcatgctgaccaagatcgtggcggccaagcgggcagccaagtcgggggcccacaccgtgatcgcctcgggccgcgaggccgacgtgctggcgcggctggccggcggcgaggccatcggcacgcaactgcgcgcgccgaccgggcgcatggctgcgcgcaagcagtggatgatcgaccacctgcaactgcgcggccgcgtcgtgctggatgccggtgcggtcgacaagctcacggccggcggcaagtcgctgttgccgatcggcgtgacggaagtgcagggcgagtttgcgcgcggggaagtgatttcgtgcgtcgacacggccgggcgcgaagtggcgcgcgggctgaccaactattccgccgccgaggcgcggctgattgcccgcaaagcgtcttcggagatcgaggcggtgctgggatatgtcagcgccgccgagctggtgcaccgcgacaacctggtgctgctctga

SEQ ID NO: 603 - protein, 374 aa, Ralstonia solanacearum
MALRSLIADARRLVVKVGSSLVTDDGRGLDQAAIARWAAQIAALRAAGKEVVLVSSGAIAEGMQRLGWTRRPKEIHELQAAAAVGQMGLAQVYESEFARHGIRTAQVLLTHGDLADRERYLNARSTLLTLLGLGVVPIINENDTVVTDEIKFGDNDTLGALVTNLIEGDALIILTDQRGLYTADPRKHPDARFVDEAQAGAPELEAMAGGAGSSIGKGGMLTKIVAAKRAAKSGAHTVIASGREADVLARLAGGEAIGTQLRAPTGRMAARKQWMIDHLQLRGRVVLDAGAVDKLTAGGKSLLPIGVTEVQGEFARGEVISCVDTAGREVARGLTNYSAAEARLIARKASSEIEAVLGYVSAAELVHRDNLVLL

SEQ ID NO: 604 - DNA, 1131 bp, Rhodopseudomonas palustris
  CDS (1)..(1131): transl_table=11
atggccagccctaagcttcacgatttccgccacatcgtcgtcaaggtcggctcgtcgctgctgatcgactccgccgccggcgaggtgcgggccgggtggctggcggcgctcgccgccgacattgccgagctgcatcgtggcggcagggacgtgatggtggtgtcgtcgggctcgatcgcgctcggacggagccggctgaagctgccgcgcggcccgctcaagcttgaggaaagccaggccgccgcggcggtcgggcaaatcgaactggcgcggacctggtcggaagtgctcggcgcccatggcatcggcgccggccagattctggtgacgttccaggacaccgaagagcggcggcgctatctcaacgcccgctcgaccatcgccaagctgctggaatggcgagcggtgccggtgatcaacgaaaacgacaccgtcgccaccaccgagattcgctacggagataacgaccggcttgcggcgcgggtcgccaccatggcgagcgccgatctgctgatcctgctgtccgacattgacgggctgtacaccgcgccgcccggcagcaatccggacgccacgctgattcctgtcgtcgaagcgatcaccgccgagatcgagggcatggccggggcggcaggctcggagctgtcgcgcggcggcatgcgcaccaagatcgaggcggccaagatcgcgacctccgctggcactcatatgctgatcgcctccggcaagatcgatcatccgctcaaagcgatcgccgacggcggcaagtgcacttggttcctgacgccggccaatccggtgacggcgcggaagcgctggattgccggcacgctggagccgaagggcacgctgacgatcgatgccggcgcagtcagcgcgctgcgcgccggcaagagcctgctgccggccggcgtgatccgggtcgacggtcaattttcccgcggcgacgccgtgatcgtgcgcggcccggacacccatgagatcggccgcggcctggtcgcttacgacgccgaggatgccgagaagatcaaaggccactcgtcgccggacgtgatgatgatcctcggaatcaccggccgcgccgagatgatccatcgcgacgatctagtcgtcggaacggcgccgacctga

SEQ ID NO: 605 - protein, 376 aa, Rhodopseudomonas palustris
MASPKLHDFRHIVVKVGSSLLIDSAAGEVRAGWLAALAADIAELHRGGRDVMVVSSGSIALGRSRLKLPRGPLKLEESQAAAAVGQIELARTWSEVLGAHGIGAGQILVTFQDTEERRRYLNARSTIAKLLEWRAVPVINENDTVATTEIRYGDNDRLAARVATMASADLLILLSDIDGLYTAPPGSNPDATLIPVVEAITAEIEGMAGAAGSELSRGGMRTKIEAAKIATSAGTHMLIASGKIDHPLKAIADGGKCTWFLTPANPVTARKRWIAGTLEPKGTLTIDAGAVSALRAGKSLLPAGVIRVDGQFSRGDAVIVRGPDTHEIGRGLVAYDAEDAEKIKGHSSPDVMMILGITGRAEMIHRDDLVVGTAPT

SEQ ID NO: 606 - DNA, 1128 bp, Rhodospirillum rubrum
  CDS (1)..(1128): transl_table=11
gtgatcaagatcggctcggcccttctcgtcgatcagggcagcgggctggtgcgcaccggctggctcaaggccctggccgaagacatcgcccagctgcgcgccgaagggcgcgaggtgctgatcgtctcctcgggggcgatcgccgtcggccggcgctcgctgcatctggaaccgggccgcatgcggcttgatgaaaagcaggccgccgccgccgccggccagatcgaactggcccatgcctatcgcacggtgatggccgatcacgccatcaacgtcgcccaattgctgctgacccttgatgactccgagaaccgccggcgttatctcaacgcccgcaactgcctggaaaccctgctccggctaggcgtcatcccggtcatcaacgaaaacgacaccgtcaccacccaggaaatccgctttggcgacaacgaccggctggccgcccgcgtcgcccagatggcctgcgccgacgcgttgatcctgctttcggatatcgatggcctttataccgccgatccccaccgcgatcccgaggcccgcttcatccccaccgtcaccgccctgaccccggagatcgccgccatggccggggcggcgctgaccccgcatggcaccggcggcatggtcaccaagcttctggccgcgcgcatctgcatggatgccggctgcgccatggcgatcgccccgggcaaggacgaccacgccttgcgcctgctgcgccagggcggccgccagacctggttcctgccggccgaagagccgcgcacggcgcgcaaggcatggatttccggggcgctgaaggccgaggggaccctgtgggtcgatgacggcgccgcccgggcgctggcggcgggcagcagcctgttgccgccgggcgtgcgcacggtcgagggcgatttccagcgcggcgccgccgtgcgggtggtcgggctcgacggcagcccgctggccaaggggctgatcgcctatccctccgacgaggcgcgtttgctcgtcggccatcgcagcggcgacatcgaggcgctgctgggataccgtgggcgcgaggaactgatccaccgcgatgatctggtgctcgacagccgcttccggcaccgcgacgaggacggggaaggacaccgatcgtga

SEQ ID NO: 607 - protein, 375 aa, Rhodospirillum rubrum
MIKIGSALLVDQGSGLVRTGWLKALAEDIAQLRAEGREVLIVSSGAIAVGRRSLHLEPGRMRLDEKQAAAAAGQIELAHAYRTVMADHAINVAQLLLTLDDSENRRRYLNARNCLETLLRLGVIPVINENDTVTTQEIRFGDNDRLAARVAQMACADALILLSDIDGLYTADPHRDPEARFIPTVTALTPEIAAMAGAALTPHGTGGMVTKLLAARICMDAGCAMAIAPGKDDHALRLLRQGGRQTWFLPAEEPRTARKAWISGALKAEGTLWVDDGAARALAAGSSLLPPGVRTVEGDFQRGAAVRVVGLDGSPLAKGLIAYPSDEARLLVGHRSGDIEALLGYRGREELIHRDDLVLDSRFRHRDEDGEGHRS

SEQ ID NO: 608 - DNA, 1113 bp, Rhodobacter sphaeroides
  CDS (1)..(1113): transl_table=11
atgccgcttcaggcgccggatatccgcagcgccaagcgtctggtcgtgaagatcggctcggcgctcctcgtggatggcgaggggctgcgccgccaatggctctcggcgctggcgctcgacgtggccgaggcgcggacgcggggcacgcaggtgatcctcgtctcctcgggctcgatcgcgctcgggcggcgggtgctgcatctgccgccggggccgctcgcgctcgaacagagccaggcggcggcggccgtgggccagatccggctcgcccgcgcctatgaggaggtgctggccccgcacggcatcaccaccgcgcaggtgctggtcacgctcgaggataccgaggaccggcggcgctacctcaattcccgcgccacgatggagacgctgctcgggctcggcaccgtgcccatcgtgaacgagaacgacacggtcgccaccgacgagatccgcttcggcgacaacgaccggctggccgcgcagatcgcggtgacggtgggggcggatcagctcgtgctcctgtccgacgtggacggcttctattcggccaatcccaaggaagatcccaccgccgagcggttcgatctggtcgagacgatcacgcccgcgctcgaggcgatggcgggcgatccggtttcgggcctgtccaagggcggcatgaagaccaagatcatggcggccaagaccgccgtcgccggcggctgcgccatggcgatcaccgaaggctcggcgatgcggccgctcaaggcgctggaacagggcgcggcgcgcacctggtttgtggcgcagggcgacccgcaggcggcgcgcaagcgctggatcaacgcgatgaagccgcgcggcacgatccgggtggatgcgggtgcggtgcaggcgctgcaggcgggcaagtcgctgctgcccgcgggcgtggtggcggtcgagggcaatttcgggcgcggcgatccggtcgagatcgcggggcccatgggcgaggtgctgggacgcgggctcacccgctacacggcggtcgaggcggtgcagatcgcgggccaccgctcggccgagatcgtggccatcctcggctacagcggccgggcagccctcatccatcgcgacgatatggtgatctga

SEQ ID NO: 609 - protein, 370 aa, Rhodobacter sphaeroides
MPLQAPDIRSAKRLVVKIGSALLVDGEGLRRQWLSALALDVAEARTRGTQVILVSSGSIALGRRVLHLPPGPLALEQSQAAAAVGQIRLARAYEEVLAPHGITTAQVLVTLEDTEDRRRYLNSRATMETLLGLGTVPIVNENDTVATDEIRFGDNDRLAAQIAVTVGADQLVLLSDVDGFYSANPKEDPTAERFDLVETITPALEAMAGDPVSGLSKGGMKTKIMAAKTAVAGGCAMAITEGSAMRPLKALEQGAARTWFVAQGDPQAARKRWINAMKPRGTIRVDAGAVQALQAGKSLLPAGVVAVEGNFGRGDPVEIAGPMGEVLGRGLTRYTAVEAVQIAGHRSAEIVAILGYSGRAALIHRDDMVI

SEQ ID NO: 610 - DNA, 1122 bp, Saccharophagus degradans
  CDS (1)..(1122): transl_table=11
atgagcaaaagacagttagttaagcagagtcgtcgttgggtaataaaaataggtagtgcgctattaaccaataacggacgtggtttagatcgcgaagaaatggctgtgtgggtaaagcagatggctgctttatccaagcgaggctatgaggtggtgttggtgtcttccggtgcggttgcggcgggtatgacgcgcttggggtgggccgagcggccaaaggcgctgcacgagcttcaggctgccgctgcggtggggcagtccagtttaattcaggcctacgagcaagagtttcaaaaatacagcattaaaactgcgcaaatcctgttggatcacgatgatttatctaatcgtcagcgctaccttaatgcgcgctccacgctgcgcacactcactaagttgggcgtgattcctattgttaacgaaaacgatacggtggtaaccgacgaaattcgctttggggataacgataccttgggtgcgttggtggccaatcttatcgaggctgacactctgtgcattctcaccgatcaaaaagcgatgttcgatagcgaccccaggcaaaatgcgctggctaaaatgcttattgagcgttcggcgttcgacccagggttggatgcgatggcgggtgatggcggtgcgcttggtcgcggcggcatgatcagcaaggtgcgcgcggcgcgtttggctgctcgttctggggcgaatactattgttgtgggcggtaaggtttttgatgttattccgcgggtggcgagcggcgaaattttaggaacgttactgtattccgagtcgcagcctattgctgcgcgcaagcgctggctggcgggtaatatgcagccccgagggcgtttaaccctagacgacggtgcggtgaaagtgttgcgcgagcagggtaagagtttattgcctgttggtgtgcgcgccgtagaagggtattttactcgcggcgagctagttttgtgtgaagatactgctggccgcgaaattgcgcgtggcttagtgaattacagtagcgatgaaacaaataaaattaaaggtgcttccagctcgcgtatagattcgctgcttggctacaaagattacgacgagcttatccatcgcgataacctggtattggtttaa

SEQ ID NO: 611 - protein, 373 aa, Saccharophagus degradans
MSKRQLVKQSRRWVIKIGSALLTNNGRGLDREEMAVWVKQMAALSKRGYEVVLVSSGAVAAGMTRLGWAERPKALHELQAAAAVGQSSLIQAYEQEFQKYSIKTAQILLDHDDLSNRQRYLNARSTLRTLTKLGVIPIVNENDTVVTDEIRFGDNDTLGALVANLIEADTLCILTDQKAMFDSDPRQNALAKMLIERSAFDPGLDAMAGDGGALGRGGMISKVRAARLAARSGANTIVVGGKVFDVIPRVASGEILGTLLYSESQPIAARKRWLAGNMQPRGRLTLDDGAVKVLREQGKSLLPVGVRAVEGYFTRGELVLCEDTAGREIARGLVNYSSDETNKIKGASSSRIDSLLGYKDYDELIHRDNLVLV

SEQ ID NO: 612 - DNA, 1104 bp, Serratia marcescens
  CDS (1)..(1104): transl_table=11
atgaacggcagccagacattggttgtgaaattgggcaccagcgtgttgaccggcggatcgctgcgtctgaaccgcgcccacatcgtcgaattggtgcgccagtgcgcgcagcaacacgccgcgggccaccgcattgtcatcgtcacctccggcgccatcgccgccgggcgcgaacacctgggctaccccgagctgcccgccaccatcgcttccaagcagctgctggcagcggtggggcagagccggctgatccagctgtgggaacagctgttctccatttacggtatccacgtcgggcagatgctgctgacgcgcgccgatctggaagaccgcgagcgcttcctcaacgcgcgcgataccatgacggcgctgctggacaaccgcatcgtgccggtaatcaatgagaacgacgccgtcgccaccgccgaaatcaaggtgggcgacaacgataacctgtcggcactggcggccattctggccggggccgacaaactgctgctgctgaccgatcagcagggcctctacaccgccgatccgcgcaacaatccgcaggccgaactgatccgtgaagtgcacggcatcgacgacgcgctgcgcgccatcgccggcgacagcgtctccggtctgggcaccggcggcatgggcaccaagctgcaggcggccgacgtggcctgccgcgccggcatcgacgtggtgatcgccgcgggcagcaagccgggcgtggtggcggacgtgatcgaaggcaaaccggtgggcacccgtttccacgcgttggaaaccccgctggaaaaccgcaagcgctggatctttggcgcgccaccggccggtgagatcaccgtcgacgacggcgcggtggaagcgatgatggcgcgcggcagctcgctgttgccaaagggcatccgcgaagtgaagggcgacttctcgcgcggcgaagtgatccgtatccgcaacctgacggggcgcgatctggcgcacggcgtcagccgctacaacagcgacgcgatgcgcatgatcgccgggcaccactcgcaggaaatcagcgagatcctcggttatgaatacggtccggtggcagtgcaccgcgacgatatgattgtcagttaa

SEQ ID NO: 613 - protein, 367 aa, Serratia marcescens
MNGSQTLVVKLGTSVLTGGSLRLNRAHIVELVRQCAQQHAAGHRIVIVTSGAIAAGREHLGYPELPATIASKQLLAAVGQSRLIQLWEQLFSIYGIHVGQMLLTRADLEDRERFLNARDTMTALLDNRIVPVINENDAVATAEIKVGDNDNLSALAAILAGADKLLLLTDQQGLYTADPRNNPQAELIREVHGIDDALRAIAGDSVSGLGTGGMGTKLQAADVACRAGIDVVIAAGSKPGVVADVIEGKPVGTRFHALETPLENRKRWIFGAPPAGEITVDDGAVEAMMARGSSLLPKGIREVKGDFSRGEVIRIRNLTGRDLAHGVSRYNSDAMRMIAGHHSQEISEILGYEYGPVAVHRDDMIVS

SEQ ID NO: 614 - DNA, 1119 bp, Shewanella oneidensis
  CDS (1)..(1119): transl_table=11
atgaatttaagtgagatagcgtatcgccgcgtggtagtgaagttggggacgagtgtgctgacttctggcagtaaacagctagataaagcccatatggttgagcttgctcgtcaaatggccgcactgatgagatcaggggtcgaagtcgttttatgtacttctggggcaattgccgcaggacgcgaacatctccaatacccggcactgcccgacactatggccaataagcaattattagccgctgtcgggcaaagccagcttattctcgcttgggcgcaactctttagtatctacggtttgcatgtggggcaattgctgctgacccgcgccgatttacacgatagagagcggtatttgaatgcccgcgacactctgaatgctttgctggcaaacaatattatccccatcatcaatgaaaacgatgcggttgcaactaacgaaatcaaagtgggcgacaacgacaatttgtcagcgcgagcggcgttgctgtgtgatgctgacctgctgatcttactgacagatcaaaagggcttattcgacgccgatccgcgtaccaatcccaatgccaaactgatttctcaggtcgagaagattgatgatagtctgcgcctgttagcgggtggctcggtttctggtttaggcacgggcggcatgtcgactaagctagaggccgctgatattgcccgccgcgctgggattgaagtggtgatcgcctcaggtcatcatcccgatgtgattaaaaaagtcgttgctaaagaatccattggcacccattttagcgccatcgaaaacccattagaaagccgcaaacagtggattttggcggggcccgcggcccaaggttcactggtgctcgatgctggagcggttaaagccgtcactgaaaaaggccgcagcctgttatcgaagggcattattggcgtcaaaggggaatttgaacggggtgcaactctgcaattagttgaccaaaacggcaaaattattgccagaggcataacccgttactgtggtgaggcgttagggttaattgcgggtaaacattccgacgaaatcgagtctgtgctcggttacgattatggtgacgcaattgtccaccgtaacgatatggtcgtcttataa

SEQ ID NO: 615 - protein, 372 aa, Shewanella oneidensis
MNLSEIAYRRVVVKLGTSVLTSGSKQLDKAHMVELARQMAALMRSGVEVVLCTSGAIAAGREHLQYPALPDTMANKQLLAAVGQSQLILAWAQLFSIYGLHVGQLLLTRADLHDRERYLNARDTLNALLANNIIPIINENDAVATNEIKVGDNDNLSARAALLCDADLLILLTDQKGLFDADPRTNPNAKLISQVEKIDDSLRLLAGGSVSGLGTGGMSTKLEAADIARRAGIEVVIASGHHPDVIKKVVAKESIGTHFSAIENPLESRKQWILAGPAAQGSLVLDAGAVKAVTEKGRSLLSKGIIGVKGEFERGATLQLVDQNGKIIARGITRYCGEALGLIAGKHSDEIESVLGYDYGDAIVHRNDMVVL

SEQ ID NO: 616 - DNA, 1107 bp, Silicibacter pomeroyi
  CDS (1)..(1107): transl_table=11
ttggcaaccctgacgacagcccggcggctggtggtcaagatcggctcggccctgctggtcgatcgcaacacgggcgacctgcgcgccgactggctgcattctctggcggccgacgtggcctggctcaaggggctgggcctggatgtgatcctggtctcgtccggctcgatcgcgttggggcggggcgtgttgggcctgccgcgcacggcgctgccgctggaacagtcgcaggccgccgccgccgtgggtcagatccgtctggcccgcgcctatgaagaggcgctggccccgcacaggatcacaaccgcgcaggttctggtcacgctggaggatagcgaggatcgccgccgctatctgaattcgcgcgcgacgctggaaacgctgctgggccttggggcggtgcccatcgtcaacgagaacgacaccgtcgccaccgacgagatccgctatggcgacaatgaccggctggctgcacagatcgcggtcaccgtgggcgccgatcagctgattctgctgtcggatgtggacgggttctataccggcaaccccagcgacgatccgggcgccacccggttcgacgtgatcgaccggatcacgcccgagatcgtggcgatggcaggggatgcaggctcgggcctgtccaagggcggcatgaagaccaagctgatggcggcacagatggccaccgccggcggctgcgccatggcaattaccgaagggtcgcctctgaacccgctgaaaacgctggaaaacggtgccaactgcacctggttcaccgcaacgcttgatccgcaggcggcgcgcaaacgctggattgcggcgatgaagccgcgcggcgacatcaccgtcgatgcgggtgctgcgcgcgcgctggagggcggcaaaagcctgctgcctgcgggcgtggcctcggtcaccggcgatttcgggcgcggcgatccggtggcgatcctcgggcctgacgggcggcgcctgggtcaggggctgtgccgctataccggggacgaggcgcgcgccattcgcgggcggcagtcttcggatatcgaggcgacgctgggctacccaggccgcgccgcgctgatccaccgggacgacatggcgctttga

SEQ ID NO: 617 - protein, 368 aa, Silicibacter pomeroyi
MATLTTARRLVVKIGSALLVDRNTGDLRADWLHSLAADVAWLKGLGLDVILVSSGSIALGRGVLGLPRTALPLEQSQAAAAVGQIRLARAYEEALAPHRITTAQVLVTLEDSEDRRRYLNSRATLETLLGLGAVPIVNENDTVATDEIRYGDNDRLAAQIAVTVGADQLILLSDVDGFYTGNPSDDPGATRFDVIDRITPEIVAMAGDAGSGLSKGGMKTKLMAAQMATAGGCAMAITEGSPLNPLKTLENGANCTWFTATLDPQAARKRWIAAMKPRGDITVDAGAARALEGGKSLLPAGVASVTGDFGRGDPVAILGPDGRRLGQGLCRYTGDEARAIRGRQSSDIEATLGYPGRAALIHRDDMAL

SEQ ID NO: 618 - DNA, 1107 bp, Silicibacter sp
  CDS (1)..(1107): transl_table=11
ttggcagccctaagcacggcgcggcgcgtcgtcatcaagatcggctccgcccttttggtggatcgcaccagcagtgccttgcggcaggagtggctcctgtcgctggcagaggatgtggcccgcctgaaaaaacagggcaaggatgtgatcctcgtgtcctcgggctcgattgcgctggggcgcggtgccctgggcctgccgcgcaaggatctgccgcttgaacagtcacaggccgccgcagctgtgggccagatccggcttgcgcgcgcttatgaggaggccctggcgccgcatgggatcaccacggcgcaggtgcttgtaacgctggaggacagcgaaaaccgccgccgttacctcaattcccgcgccacgctcgagactttgatcggtctgggcgcggtgcccatcgtcaatgagaacgataccatcgccaccgacgagatccgctatggcgacaacgaccgtctggcggcccaggtcgcggtgacggtgggggccgatgtgctgatcctgttgtcggatgtggacgggttctacagcgccaatcctgcgcttgatccagacgccaaacggtttgaccggatcgaacagatcacgcccgagatcgaggcaatggcgggcgatggggtctcggggctgtccaaaggcggcatgatcaccaagctcttggcggccaagatggccaccgccgcaggctgcgccatggcaatctccgaaggatcggtgatgtcgccggtttcggcacttgaggctggggctgcttcgacgtggttcacagcccaaggtgacccgcaggtcgcgcgcaaacgctggatcgccgcgatgaaaacccgcggcgtgatcaccgtggatgaaggtgcggccaaggcgctgcacaacggaaacagtctgctgcccgcaggggtgcgtcatgtggagggtgactttggccgcggagatccgctggccatcctcggcccagatggccgtaagctggggcaggggctgagccgctacacggccgaggaagcccgcgcccttcagggacatcgttcggatgagatcgaggcgatcctcggctatgctggacgtgcggccctgatccaccgggatgacatggcgctttga

SEQ ID NO: 619 - protein, 368 aa, Silicibacter sp
MAALSTARRVVIKIGSALLVDRTSSALRQEWLLSLAEDVARLKKQGKDVILVSSGSIALGRGALGLPRKDLPLEQSQAAAAVGQIRLARAYEEALAPHGITTAQVLVTLEDSENRRRYLNSRATLETLIGLGAVPIVNENDTIATDEIRYGDNDRLAAQVAVTVGADVLILLSDVDGFYSANPALDPDAKRFDRIEQITPEIEAMAGDGVSGLSKGGMITKLLAAKMATAAGCAMAISEGSVMSPVSALEAGAASTWFTAQGDPQVARKRWIAAMKTRGVITVDEGAAKALHNGNSLLPAGVRHVEGDFGRGDPLAILGPDGRKLGQGLSRYTAEEARALQGHRSDEIEAILGYAGRAALIHRDDMAL

SEQ ID NO: 620 - DNA, 1110 bp, Synechococcus elongatus
  CDS (1)..(1110): transl_table=11
atggcacaaacactggtcgtcaaaattggcacatcgagcttagcggggggcaaagaaggaaacctagccttggccaccattgcccaactggtggaggtgctgtgtcactgtcaacggcggggcgatcgcgtggtgctcgtctcctctggggcggtgggcgtgggtgctatgcgcttgggcctgacagaacgtccccaacaattagcccaaaaacaagcagtggcagcagtgggtcaaggacacctgatgcggatgtacgatgatctctttgcggtcctgcgtcagcccattgcccaaatcctggtgacacggcaaaattttgtcgatcgccagagctacttgaatatctacaacacgttccaagcactgtttgaattgggggtcatccccattgtcaatgagaacgatacagtggcggtggatgaactcaagtttggtgacaatgataccctctcagcccttgtggcaagtcttgtcgaagccgattggttatttttgctcacagatgtcgatcgcctctattcagccgatccacgcattgataagaccgctgttcccattgagcgggtcgtctccttggccgagttagcacaaaccattcaagttgggtctgctggctccccttggggcaccggcggcatggccaccaaaattcgggctgcggaaattgccacagaagccggcgtgcgcaccgtcattaccgatgggcgatcgcccaccaacctcctgaaaatccttgggggtgaagccttgggcacccactttgaacctcgtcccaaaaccatcaatgcccgtaaacgctggattgcccgtgccctcattcccaaaggcgagttatggctagatgagggtgccgttaaggcaatcaccgtgggtggcaagtccctcttagcagcaggcattacccgtgtggaaggggagtttcaggctcaagatgctgtgaagctctgtgaccccacaggagccgaaattgcccgtggccttgtcaactacaacagtgaagaaattcgtcgtgtccaagggcaacaatctacggaattggccaacatcctcggctatgccggtgccgatacaattgtccaccgtgacaacctagtggtgaccctgtaa

SEQ ID NO: 621 - protein, 369 aa, Synechococcus elongatus
MAQTLVVKIGTSSLAGGKEGNLALATIAQLVEVLCHCQRRGDRVVLVSSGAVGVGAMRLGLTERPQQLAQKQAVAAVGQGHLMRMYDDLFAVLRQPIAQILVTRQNFVDRQSYLNIYNTFQALFELGVIPIVNENDTVAVDELKFGDNDTLSALVASLVEADWLFLLTDVDRLYSADPRIDKTAVPIERVVSLAELAQTIQVGSAGSPWGTGGMATKIRAAEIATEAGVRTVITDGRSPTNLLKILGGEALGTHFEPRPKTINARKRWIARALIPKGELWLDEGAVKAITVGGKSLLAAGITRVEGEFQAQDAVKLCDPTGAEIARGLVNYNSEEIRRVQGQQSTELANILGYAGADTIVHRDNLVVTL

SEQ ID NO: 622 - DNA, 1113 bp, Synechococcus sp
  CDS (1)..(1113): transl_table=11
gtggctcccatgtccgagaccctcgtggtcaaaattggcaccagcagtctgaccaatccccaccatccgggcttggcactctcgacgattgcggggctggttgaagtgatttgccaactgcgccgacagggctacaacgtcgttctagtctcctcgggcgcggttggggtcggttgcactcgccttgggctgcgcgatcgccccagccgtattgcccaacgtcaggcgatcgcagcggtcggtcagggtcgcttgatgcgcacctacgacgatctgtttacgaccctcggtcagccgatcgctcaagttctgctaacgcgcggtgatctggcgcagcggcaacgctacatcaatgcctatcaaacctttcaggaactattcgagctgggcgtcgtgccaattgtcaacgagaatgacacggtcgctgttgaagaactcaagtttggcgacaatgacacgctgtcggccttagtcgccagtctcgtggaagcgcaatggctgttcctactaaccgatgttgatcggctctacacagccgaccctcgccaggatccaaatgctaagccgatcacaattgtccacgacctctcggagctggaatcgattcaagcaggtggacagggcagtcgctggggtacaggcggtatggcaacgaagttgactgcagcgaaaattgctacccaagcgagcgttcgtaccgtgattacccaagggcgatcgcccgaaaatctgctgaaaatcttggcgggtgaggcgatcggcacttggtttgagccgcaaccggaaacagtcaatgcccgcaaacgctggattgcccacggcctcgtgccaactggaaaactgttgctggatgctggtgcagtgcaagcgattcaagcagggggtaagtcgcttttagccgctggaattcaagcgatcgaaggagattttgaagcccaagatgcagttcagctctgtgatctcaacggcactgaaattgcccgaggattagtcaactatgacagtcacgaactgcagcagatccgtggctgtcaaagtgatcaaattgttcaaatcctaggctacgaaggtgcagaaaccatcgtccatcgcgacaacttagttttaagctag

SEQ ID NO: 623 - protein, 370 aa, Synechococcus sp
MAPMSETLVVKIGTSSLTNPHHPGLALSTIAGLVEVICQLRRQGYNVVLVSSGAVGVGCTRLGLRDRPSRIAQRQAIAAVGQGRLMRTYDDLFTTLGQPIAQVLLTRGDLAQRQRYINAYQTFQELFELGVVPIVNENDTVAVEELKFGDNDTLSALVASLVEAQWLFLLTDVDRLYTADPRQDPNAKPITIVHDLSELESIQAGGQGSRWGTGGMATKLTAAKIATQASVRTVITQGRSPENLLKILAGEAIGTWFEPQPETVNARKRWIAHGLVPTGKLLLDAGAVQAIQAGGKSLLAAGIQAIEGDFEAQDAVQLCDLNGTEIARGLVNYDSHELQQIRGCQSDQIVQILGYEGAETIVHRDNLVLS

SEQ ID NO: 624 - DNA, 1104 bp, Synechococcus sp
  CDS (1)..(1104): transl_table=11
atgtccgagaccctcgtggtcaaaattggcaccagcagtctgaccaatccccaccatccgggcttggcactctcgacgattgcggggctggttgaagtgatttgccaactgcgccgacagggctacaacgtcgttctagtctcctcgggcgcggttggggtcggttgcactcgccttgggctgcgcgatcgccccagccgtattgcccaacgtcaggcgatcgcagcggtcggtcagggtcgcttgatgcgcacctacgacgatctgtttacgaccctcggtcagccgatcgctcaagttctgctaacgcgcggtgatctggcgcagcggcaacgctacatcaatgcctatcaaacctttcaggaactattcgagctgggcgtcgtgccaattgtcaacgagaatgacacggtcgctgttgaagaactcaagtttggcgacaatgacacgctgtcggccttagtcgccagtctcgtggaagcgcaatggctgttcctactaaccgatgttgatcggctctacacagccgaccctcgccaggatccaaatgctaagccgatcacaattgtccacgacctctcggagctggaatcgattcaagcaggtggacagggcagtcgctggggtacaggcggtatggcaacgaagttgactgcagcgaaaattgctacccaagcgagcgttcgtaccgtgattacccaagggcgatcgcccgaaaatctgctgaaaatcttggcgggtgaggcgatcggcacttggtttgagccgcaaccggaaacagtcaatgcccgcaaacgctggattgcccacggcctcgtgccaactggaaaactgttgctggatgctggtgcagtgcaagcgattcaagcagggggtaagtcgcttttagccgctggaattcaagcgatcgaaggagattttgaagcccaagatgcagttcagctctgtgatctcaacggcactgaaattgcccgaggattagtcaactatgacagtcacgaactgcagcagatccgtggctgtcaaagtgatcaaattgttcaaatcctaggctacgaaggtgcagaaaccatcgtccatcgcgacaacttagttttaagctag

SEQ ID NO: 625 - protein, 367 aa, Synechococcus sp
MSETLVVKIGTSSLTNPHHPGLALSTIAGLVEVICQLRRQGYNVVLVSSGAVGVGCTRLGLRDRPSRIAQRQAIAAVGQGRLMRTYDDLFTTLGQPIAQVLLTRGDLAQRQRYINAYQTFQELFELGVVPIVNENDTVAVEELKFGDNDTLSALVASLVEAQWLFLLTDVDRLYTADPRQDPNAKPITIVHDLSELESIQAGGQGSRWGTGGMATKLTAAKIATQASVRTVITQGRSPENLLKILAGEAIGTWFEPQPETVNARKRWIAHGLVPTGKLLLDAGAVQAIQAGGKSLLAAGIQAIEGDFEAQDAVQLCDLNGTEIARGLVNYDSHELQQIRGCQSDQIVQILGYEGAETIVHRDNLVLS

SEQ ID NO: 626 - DNA, 1074 bp, Synechococcus sp
  CDS (1)..(1074): transl_table=11
atgacgctgtgggtggtgaagctgggcacgagcttgttgcggggggataccgccgcaacgatcgctggtttcgccgcaggcattgctgctgccttcgcaaggggcgatcgcgttgtgctggtttccagtggtgctgtcggcctcggttgccagcggcttcagcttccccagaggcccgagaccgtggtggccctgcaggcggcggctgccaccgggcagggtcagctgatggctttgtacgaacgggccttggcgaaccacggcatcgctgtggcccagatccttgtcacccggtcagatctggctgatcgtcgccgttatcagaacgcctcaggaaccctgcagcagctgttgcagtggggtgtgttgccggtggtcaatgaaaacgacgctatctccccggcggagctccgcttcggagacaacgacaccctgtctgccctagtggcggcggccgttggtgccgaccagctcatcctgctcaccgacgtggaccgtctgtactcagccgatccgcggcttgtcgtcgatgcccgcccgatttccgatgtgcaccacccacgggagctcgacgcccttgaagccgtcgccggtgatggcggacgttggggccgcggcggcatgaccaccaagctggcggcggccaggattgccaccgccagcggcatcactgtgcatctggcagatggtcgggatcccaggcgcctcgatgccctgcttcagggggaacgcgggggaacggtgtttcatccccacccggaacccctgggcaaccgtcgcagctggctggctcatgccttgcaaccccagggcgagctgacgctggatgccggtgcctgcgatgccttgcatcagcgggggtcctccctgttgatggttgggattactgcggtgaagggggtgttcggcgccaatcaaccggtccggttgcagggtcctgacggccgcgagctgggacgcggcctttgccagctgtccagcgcagctgttcagcgcgctcttgatgctgcgccggccgctggtccatcgcctgtggtggtgcatcgggacgccctggtgcttcacagccgctga

SEQ ID NO: 627 - protein, 357 aa, Synechococcus sp
MTLWVVKLGTSLLRGDTAATIAGFAAGIAAAFARGDRVVLVSSGAVGLGCQRLQLPQRPETVVALQAAAATGQGQLMALYERALANHGIAVAQILVTRSDLADRRRYQNASGTLQQLLQWGVLPVVNENDAISPAELRFGDNDTLSALVAAAVGADQLILLTDVDRLYSADPRLVVDARPISDVHHPRELDALEAVAGDGGRWGRGGMTTKLAAARIATASGITVHLADGRDPRRLDALLQGERGGTVFHPHPEPLGNRRSWLAHALQPQGELTLDAGACDALHQRGSSLLMVGITAVKGVFGANQPVRLQGPDGRELGRGLCQLSSAAVQRALDAAPAAGPSPVVVHRDALVLHSR

SEQ ID NO: 628 - DNA, 1128 bp, Synechocystis sp
  CDS (1)..(1128): transl_table=11
atgacaatggcaatgcaaccccaaactttggtgattaaaattggtacttctagcctagctcgtccggaaacgggtcagttggccctctccaccattgccgctttggtggaaactgtatgcaagttgatcggccaaggccatcgggtggtgctagtctcctctggagccataggagtaggttgtagtcgtttgggcctgacagaaaggccaaaaaaaatggccttaaagcaggcgatcgccgctgtgggccagggcagattaatgcggacctatgacgacctttttagtagcctccggcaacccattgcccaaattttgctcaccagacgggaattaattgagcgtaccgcctatgtcaacgcctacaacacgttccaagctctgtttgagttgggggtgattgccattgtcaatgaaaacgacacggtggcgatcgatgaactaaaatttggcgacaatgatactttgtcggctttagtggccagcttggtggaagcggattggctatttttgctcactgacgttgaccgcctttattccagtgacccccgtttagatcccgatgcctatcccattcccctagtcaaagccgcggaattagcccaattacaagtccgcaccgatagcactggttccgcctggggcaccggcggcatggccaccaaaatcaccgctgcccgcattgctacgggatcaggagtccgcaccgtcatcacccatggccaaaaacctgagcaaattttagccatcctccagggagctaatttgggcactcagtttgaagcccaaccccgctccgataatgctcgtaaacgttggatcgcctatggtttagtgcccaccgggaaaattttcattgacgctggggcggtccaggccctcaaagctaggggcaaatccctattggcgatcggggtggttgccctagaaggggaattcagtgccaccgatgccgtcataatctgtgatccccagggtcaagaattagggcggggattagttaattacaactgtaacgagctagaaaaaattaagggactccattccgaggcgatcgccgcagtgttaggctacgtggggccagatacagtgatccatcgagataatttagtattacaagaaaattag

SEQ ID NO: 629 - protein, 375 aa, Synechocystis sp
MTMAMQPQTLVIKIGTSSLARPETGQLALSTIAALVETVCKLIGQGHRVVLVSSGAIGVGCSRLGLTERPKKMALKQAIAAVGQGRLMRTYDDLFSSLRQPIAQILLTRRELIERTAYVNAYNTFQALFELGVIAIVNENDTVAIDELKFGDNDTLSALVASLVEADWLFLLTDVDRLYSSDPRLDPDAYPIPLVKAAELAQLQVRTDSTGSAWGTGGMATKITAARIATGSGVRTVITHGQKPEQILAILQGANLGTQFEAQPRSDNARKRWIAYGLVPTGKIFIDAGAVQALKARGKSLLAIGVVALEGEFSATDAVIICDPQGQELGRGLVNYNCNELEKIKGLHSEAIAAVLGYVGPDTVIHRDNLVLQEN

SEQ ID NO: 630 - DNA, 1113 bp, Thermus thermophilus
  CDS (1)..(1113): transl_table=11
atgcgcccggggctttcggccaagcgcctggtggtcaaggtgggaagcgccgtcctcacaggggaaaggggcctggacctcgaggccatggccgagatcgcccgccaggtggccgccctgagggaggaaggccgggaggtggtcctcgtctcctcgggggcggtggcggcgggaatgcgacggctcgggctaaaggagcgccccaaggacatgcccaagaagcaggccctcgccgccctcggccagcccctcctcatggccttctggcaagaggccttcgcccccttcggccttcccgtggcccaggtcctcctcaccgccgaggacctctcctccaggagccgctacctgaacgccaaggccaccttgcgggccctcctggacctgggggccatacccgtgatcaacgaaaacgacaccgtggcctttgaggagatccgctttggggacaacgaccagctctccgcccgggtggcggccctggtggaggcgggcctcctcgccctcctctccgatgtggacgccctctacgaggaggaccccaagaaaaacccccaggcccgccccatccccgaggtggagtccgtggaggcggttttggcccacgccggagaggaaaacccgctaggaagcggggggatgaagagcaagctcctcgccgcccgcatcgccggtagggtggggatccccaccctgcttctccccgggaagcggccaggggtcctcctccaagccctctccggggcccccctgggcacctacttccacgcgcggcggcgctaccggggggaaaaggcctggctttttggcctcctccgccccaagggggagctcgtcctggaccggggggcggtgcgggccttaaaggagcggggagcgagcctgcttcccgccggggttaaggaggtgcgggggaggttctcccggggcgaggcggtccgcctcctctcggaggagggcgaggaggtgggggtggggctcgccaactacgcctcggaggagatcgcccgcatcaaggggcggcggagcgcggagattgaggccgtcctgggctaccgctacaccgaggaggtggtccaccgggaccacctcgccttgaaggaggaggcatga

SEQ ID NO: 631 - protein, 370 aa, Thermus thermophilus
MRPGLSAKRLVVKVGSAVLTGERGLDLEAMAEIARQVAALREEGREVVLVSSGAVAAGMRRLGLKERPKDMPKKQALAALGQPLLMAFWQEAFAPFGLPVAQVLLTAEDLSSRSRYLNAKATLRALLDLGAIPVINENDTVAFEEIRFGDNDQLSARVAALVEAGLLALLSDVDALYEEDPKKNPQARPIPEVESVEAVLAHAGEENPLGSGGMKSKLLAARIAGRVGIPTLLLPGKRPGVLLQALSGAPLGTYFHARRRYRGEKAWLFGLLRPKGELVLDRGAVRALKERGASLLPAGVKEVRGRFSRGEAVRLLSEEGEEVGVGLANYASEEIARIKGRRSAEIEAVLGYRYTEEVVHRDHLALKEEA

SEQ ID NO: 632 - DNA, 1119 bp, Thermoanaerobacter tengcongensis
  CDS (1)..(1119): transl_table=11
atgaggattgtagttaaggttgggactagtactttgactcatgaaaatgggaaattgaatttagaaataatggaaaaactagtaagacaaatcgcaaatttgtcaaataaaggagaagaagttatacttgtgacgtctggggcgattggagctggaatgggaaaattaaacttgacagaaaagcccaaaaaccttccgcaaaagcaggccctagcagccattggtcaaggtctccttatagagatttacgagaaatttttcaacgaatacgggaaaataactgcccagcttcttttgacgagggaggactttagtgacagaaaaaggtatttaaatatgagctacaccctctctaaccttctcaagtggggagtcatacctgtgataaatgaaaatgacactgtggcagtagaggagataaagattggggataatgataccctggcagcccttgtggcaagccttgttgaagcagaccttttgattattttgactgatatcgatggcctttttgacaaggacccgagaatttataaggatgctaaggttatagaagtggttgaggagttttctgatgacctttttaaaatagctggcggggcaggtacaaaaagaggaacaggaggaatgtacacaaagattcaggcagccaagatatgctacaattcgggagttaaaatggtgattgcaaatggcaaaattgacaatgtattaaatagaattgcagcaggagaaaaaattgggactacttttcttcccatgaaaaatcctataagcagcagaaaaatctggattgctttcaatgcaaaggtgaatggttttttgtttgtagatgaaggggcagcaaaggctttagtaaagcatggaaaaagcttactgccaagcggtattgtaaagacagaaggccagtatgacgttggggactgcgtggcagtggtggaccaccagggcagggaaatagctagagggcttgtcaactattcttctgaggaagtcgaaaaaataaaaggctgtaagacccatgacatagagtcaatattggggtataagtactacgacgaggttattcacagggacaatctcgtagttcttgagagaggtgagaagtatggaggttga

SEQ ID NO: 633 - protein, 372 aa, Thermoanaerobacter tengcongensis
MRIVVKVGTSTLTHENGKLNLEIMEKLVRQIANLSNKGEEVILVTSGAIGAGMGKLNLTEKPKNLPQKQALAAIGQGLLIEIYEKFFNEYGKITAQLLLTREDFSDRKRYLNMSYTLSNLLKWGVIPVINENDTVAVEEIKIGDNDTLAALVASLVEADLLIILTDIDGLFDKDPRIYKDAKVIEVVEEFSDDLFKIAGGAGTKRGTGGMYTKIQAAKICYNSGVKMVIANGKIDNVLNRIAAGEKIGTTFLPMKNPISSRKIWIAFNAKVNGFLFVDEGAAKALVKHGKSLLPSGIVKTEGQYDVGDCVAVVDHQGREIARGLVNYSSEEVEKIKGCKTHDIESILGYKYYDEVIHRDNLVVLERGEKYGG

SEQ ID NO: 634 - DNA, 1125 bp, Thiobacillus denitrificans
  CDS (1)..(1125): transl_table=11
gtgagcacgtcggtcgtccgccacgcacggcgcatcgtcgtcaaggtcggttccagcctggtcacggcggacgggcgcggcctcgaccacgcggcgctgtcgcgctgggccgagcagatcgccgcgctggccgaacagggcaaggaagtcgtgctcgtgtcgtcgggcgcgatcgccgagggcatcgcgcgcctcggctggaaaaagcgcccgaaagcggtcaacgagttgcaggccgcggcggcggtcgggcagatgggtctcgtgcaggcctacgagtcgatttttcgcacccacaagttgcatgcggcccaagttcttctgacccacgaggatctcgccgaccgcacgcgctatctcaacgcgcgctcgacgctacgcacgctgcttgaattacgcgtggtcccgatcatcaacgagaacgacacggtggcgaccgacgagatccgtctcggcgacaacgatacgctgggcgcgctcgtgaccaatctgatcgaagccgactgcctcgtcatcctcaccgaccaggcggggctttatacggccgatccgcgcaaggtcgccgatgcgagcctcgtcatggaggcgcacgccggcgaccccgagctcgagcgcatggccggcggggccggtagcagcgtcgggaccggcggcatgctgaccaagatcctcgccgccaagcgcgcggcgcgcagcggcgcgcacaccgtgatctgcagcggccgcgagccgcgcgtgctgctgcgtcttgccgagggcgaacccatcggcagccagctggtcgcgcgccaggcgcccctcgccgcgcgccgccagtggctcgccgatcacctgcaactgcgcggcgggctcgtgctcgacgacggcgccgtgcgcgcgctgcaggaggacggcaagagcctcctgccggtcggcgtccggggcgtgaccggagaattcgaacgcggcgaggtcgtcgccgtcgtcgacgcgagcggacgcgagatcgcccgcggcctgaccaactacagcgccgccgaagcgcgccgtatcgcgggcaagcccagtaccgcgatcgaagccgagctcggctacatggacgagcccgaactgatccaccgcgacaacctggtcgttctggcgtga

SEQ ID NO: 635 - protein, 374 aa, Thiobacillus denitrificans
MSTSVVRHARRIVVKVGSSLVTADGRGLDHAALSRWAEQIAALAEQGKEVVLVSSGAIAEGIARLGWKKRPKAVNELQAAAAVGQMGLVQAYESIFRTHKLHAAQVLLTHEDLADRTRYLNARSTLRTLLELRVVPIINENDTVATDEIRLGDNDTLGALVTNLIEADCLVILTDQAGLYTADPRKVADASLVMEAHAGDPELERMAGGAGSSVGTGGMLTKILAAKRAARSGAHTVICSGREPRVLLRLAEGEPIGSQLVARQAPLAARRQWLADHLQLRGGLVLDDGAVRALQEDGKSLLPVGVRGVTGEFERGEVVAVVDASGREIARGLTNYSAAEARRIAGKPSTAIEAELGYMDEPELIHRDNLVVLA

SEQ ID NO: 636 - DNA, 1134 bp, Vibrio cholerae
  CDS (1)..(1134): transl_table=11
atgaccacaaatcaacgaagcatcaaagctccacaaacggttgttgtgaagctgggaaccagtgttctgaccggcggtactcttgcgctggatcgtgctcatatggttgagctcgctcgccagtgtgctgaactcaaaaagcaaggtcactcagtagtgatcgtgacctcgggcgccattgcggctggccgtgagcatttaggttaccctgcgctgcccaacgcgatttccagcaagcaactgctggcagcggttgggcaaagtcgtttgattcaggtctgggaatcgttatttgcgatttatggcatcaaaattggtcagatgctgctcacccgtgctgatcttgatgaccgtgagcgtttcctcaatgcgcgtgacaccatcaatgcgttagttgaaaacggcattgtgcctgtagtcaacgaaaacgatgcggtagcaaccaatgaaatcaaagtcggtgacaacgataacttatcggcgctggtcggtattttgtgtggcgcggataagctgctgctgttgaccgatcaaaaaggcttgttcaccgccgacccgcgtaaagatcccaatgcgcaactgatcaaagaagtgaccaccattgatgacacactgcgcaaaattgctggtggcagtggcactacactcggtacgggcggcatggccaccaagctgcaagcggcggacattgctcgtcgtgctggtattgaagtcatcattgcggcaggtcgtgcgcccaatgtgatttttgactccttaagtgatgagccacaaggcacgcgcttcttagctttggaagaagcgttagaaaaccgcaaacgctggattttggcaggcccagcggcatcgggtgatatcgtgattgacgatggcgcagtgaaagcggtgcaaaccaagggcagcagcttgctcgccaaaggtgtggtgcgagtgcaaggtcagttcgcccgtggtgaagtggtgcgggtactggacaagcaaagtcatctgattgcgcgcggcatcgcggcctactccaatgacgagttggcgcaaattgctggtaagcacagtaaagagatcatcgatattttaggctacgatcacggctcagaagtgatccaccgcgacgacatggtcgtgattcaagaataa

SEQ ID NO: 637 - protein, 377 aa, Vibrio cholerae
MTTNQRSIKAPQTVVVKLGTSVLTGGTLALDRAHMVELARQCAELKKQGHSVVIVTSGAIAAGREHLGYPALPNAISSKQLLAAVGQSRLIQVWESLFAIYGIKIGQMLLTRADLDDRERFLNARDTINALVENGIVPVVNENDAVATNEIKVGDNDNLSALVGILCGADKLLLLTDQKGLFTADPRKDPNAQLIKEVTTIDDTLRKIAGGSGTTLGTGGMATKLQAADIARRAGIEVIIAAGRAPNVIFDSLSDEPQGTRFLALEEALENRKRWILAGPAASGDIVIDDGAVKAVQTKGSSLLAKGVVRVQGQFARGEVVRVLDKQSHLIARGIAAYSNDELAQIAGKHSKEIIDILGYDHGSEVIHRDDMVVIQE

SEQ ID NO: 638 - DNA, 1140 bp, Vibrio parahaemolyticus
  CDS (1)..(1140): transl_table=11
atgacaacgaatcaacaaaacgcagttgtttcgcaaccacaaaccgtcgttgtgaaactgggtacaagtgtgctgacaggcggcacattggcactagatcgcgctcacatggttgagctagcgcgtcagtgtgctgagcttaagaaacaaggccattcagtggtaatggtttcgtctggtgcaattgcagcaggccgtgagcatcttggataccccgcactgcccaacgagatggcgagcaaacagttgcttgctgctgtgggtcagagtcgtttgattcaaacatgggagtctttgtttggtatttacggtatcaagattggtcaaatgctactgactcgtgctgacttggatgatcgtgagcgttttcttaatgcgcgtgacaccatcaatgcgcttgtggcgaacgatattattccaatcgtgaacgaaaatgatgcagtagccaccagtgaaatcaaagtcggcgacaatgacaacctatcggctttagtgggtattttgtgtggtgcagataagttattgctactgaccgatcaaaaaggtctgtttactgcagacccacgaaaagatccgaatgcagagctgatcaaagaagttaaaaccattgatgacacgttgcgtaaaattgctggcggcagcggtacaacactcggtacgggtggtatggcgacaaaacttcaagctgctgacatcgcacgtcgcgcgggtattgaagttattatcgcagcaggtagcgcgccaaacgtaatttttgactcgttgagcacggagcctcaaggtacgcgtttcctaccttgttcagaagcattggaaaaccgtaagcgttggatcctcgcaggtcctgcagcatcgggtgacattatcatcgatgatggtgcggtgaatgcggttgttggtaaaggcagcagcttgctagcaaaaggggtcatcaaggtgagcggtgattttgcccgtggtgaagttgctcgcgtaacaaattctcatggcaaactggttgcgcgtggtattagcgcctactcaagtgaagacttggcaaaaattactggcaaacacagtaaagacatcatctctattttgggtcatgactacggctcagaagtgattcatcgcgatgatcttgtcgtcattcaagaatag

SEQ ID NO: 639 - protein, 379 aa, Vibrio parahaemolyticus
MTTNQQNAVVSQPQTVVVKLGTSVLTGGTLALDRAHMVELARQCAELKKQGHSVVMVSSGAIAAGREHLGYPALPNEMASKQLLAAVGQSRLIQTWESLFGIYGIKIGQMLLTRADLDDRERFLNARDTINALVANDIIPIVNENDAVATSEIKVGDNDNLSALVGILCGADKLLLLTDQKGLFTADPRKDPNAELIKEVKTIDDTLRKIAGGSGTTLGTGGMATKLQAADIARRAGIEVIIAAGSAPNVIFDSLSTEPQGTRFLPCSEALENRKRWILAGPAASGDIIIDDGAVNAVVGKGSSLLAKGVIKVSGDFARGEVARVTNSHGKLVARGISAYSSEDLAKITGKHSKDIISILGHDYGSEVIHRDDLVVIQE

SEQ ID NO: 640 - DNA, 1140 bp, Vibrio vulnificus
  CDS (1)..(1140): transl_table=11
atgacaacgaatcaacaaagcgtcgcagcttctcaaccaaaaactattgttgtgaagcttggaaccagtgtattgaccggtggtacattagcgttagatcgcgctcatatggttgagcttgcgcgccaatgtgcagagttaaaaaaacaaggccactctgtggtggtcgtctcgtcaggcgcgattgccgctggacgtgagcacttaggttaccccgcgctgcccaatgcgatggcaagcaaacagttgcttgctgcggttgggcaaagtcagttgattcaaacttgggaatcgttatttgcactgtatggcatcaaaattggccaaatgttgctcactcgagcggatctcgaagatcgcgaacgttttctcaatgctcgagatacgattaacgcgttagtggataacggcattatccctgtcgttaatgaaaatgacgccgtcgccacgagcgaaatcaaagtgggtgacaacgacaacctctctgcgttggtgggcattttatgtggtgctgataaactactgttgctgacagaccaaaaaggcttgtataccgccgatccgcgtaaagatcccaatgctgagctgatcaaagaagttaaagtcattgacgatactttgcgtaaaattgctggtggcagcggtacaacattaggtactggtgggatggcaacaaagctccaagctgcggacattgcgcgtcgtgctggcattgaagtcatcattgcggcaggccgtggtcaaaatgtcatttttgatgcgttgagcccagcccctcaaggaacccgtttcttgccttgtgaagaggcgttggaaaaccgcaagcgttggattctcgctggccctgcggcctctggtgatattgtgattgaccaaggtgcggtgaaagccgtggtcgaaaaaggcagcagtttgttggcgaaaggggtgaccaaagtacttggcgagttttctcgtggtgaagtggtccgtgtaacggatgcacaaggccatttggttgcgcgaggtattgcgagttattccaaccaagatatggcgaaaattgccggtaagcacagcaaagacattatttcgattctgggctatgactatggttcagaagtgattcaccgtgacgacatggttgtcattcaagaatag

SEQ ID NO: 641 - protein, 379 aa, Vibrio vulnificus
MTTNQQSVAASQPKTIVVKLGTSVLTGGTLALDRAHMVELARQCAELKKQGHSVVVVSSGAIAAGREHLGYPALPNAMASKQLLAAVGQSQLIQTWESLFALYGIKIGQMLLTRADLEDRERFLNARDTINALVDNGIIPVVNENDAVATSEIKVGDNDNLSALVGILCGADKLLLLTDQKGLYTADPRKDPNAELIKEVKVIDDTLRKIAGGSGTTLGTGGMATKLQAADIARRAGIEVIIAAGRGQNVIFDALSPAPQGTRFLPCEEALENRKRWILAGPAASGDIVIDQGAVKAVVEKGSSLLAKGVTKVLGEFSRGEVVRVTDAQGHLVARGIASYSNQDMAKIAGKHSKDIISILGYDYGSEVIHRDDMVVIQE

SEQ ID NO: 642 - DNA, 1092 bp, Xanthomonas axonopodis pv
  CDS (1)..(1092): transl_table=11
gtgctcaaggtcggcagcagcctgctcgccgccgatgggggggggctgtccccgcgcttcgcgctcggtctggcgcagttcgtctccgccaatctggcagccgggcgcgagctggtgatcgtgtcgtcgggcgcggtggccgccggccgtgccatcctgcccaaagcgatggatgtcggcgcaccgatcgcggcacggcaggcactggccgccttgggccaggcgcagttgattgcgttgtggcagcgctttttcgagcgaccggtggcgcaggtactgctcacgcatgacgacctgcgcaaccgtcgccgctacctcaatgcgcgtgccaccttgggcgagttgctgcggctgggcgcgctgccggtgatcaacgaaaacgataccgtctcggtggatgagttgaagctgggcgataacgacaacctggctgcgatcgtggctgcgctggtcgatgccgacgcgttgtttatcgccaccgatatcgatggcttgtatagcgccgacccacgcagcaacccgttggcgcgcccgctcgacgatgtgcccgagctcactccggaggtgctggcgatggccggcggcagcggtagcaatgtgggtaccggaggcatgcgcaccaaactggaagccgctgcaaaggccggcgcggccggcatcgaaacctatctgttcaacggccgaagtggcgaggtggtgcgcgccctggcgctggaccgcctgcgtggcacgcggatccacgccgcacgcacgcgcatcgctgcgcgaaaatactggctgcggcacgcaccggtggaagcgggcgcgatcctcatcgacgacggcgccgcagcggccttgaccggcaagggcgcttcgctgttgccaggcggggtggccggcgcgcagggcgatttccgtcgcggcgacatggtggagatccgtcggcgcgataccacgggcgacggacagtgtctggcacgcggcgtcagccagtattcggccctggatatccgtcgtatcgcaggccgccattcgcgcgagatcgagaacgtgctcggctacagttacggcgaaaacgtggtgcatcgcgatgatttggtggtgttgtag

SEQ ID NO: 643 - protein, 363 aa, Xanthomonas axonopodis pv
MLKVGSSLLAADGGGLSPRFALGLAQFVSANLAAGRELVIVSSGAVAAGRAILPKAMDVGAPIAARQALAALGQAQLIALWQRFFERPVAQVLLTHDDLRNRRRYLNARATLGELLRLGALPVINENDTVSVDELKLGDNDNLAAIVAALVDADALFIATDIDGLYSADPRSNPLARPLDDVPELTPEVLAMAGGSGSNVGTGGMRTKLEAAAKAGAAGIETYLFNGRSGEVVRALALDRLRGTRIHAARTRIAARKYWLRHAPVEAGAILIDDGAAAALTGKGASLLPGGVAGAQGDFRRGDMVEIRRRDTTGDGQCLARGVSQYSALDIRRIAGRHSREIENVLGYSYGENVVHRDDLVVL

SEQ ID NO: 644 - DNA, 1155 bp, Xylella fastidiosa
  CDS (1)..(1155): transl_table=11
atgaccggcacccctcccccctcccgcttccccgaacaacccatccccccgtggcgccgcgctgtcctcaaagtgggcagcagcctcctcgccgccgctggcggcggcctctccccccgctttgccttggatttagcacacttcgtctccgccaacatcaccgccggacgccaactggtcatcgtctcctctggcgctgtcgccgctggccgtgccctgatacccccactgcccgaatccggcggcgccctcgccgcacgccaagccttagccgcccttggacaagcacaactcatcgcactgtggcaacgcttcttcgaccgccccgttgcccaggtcctcctgacccatgacgacctccgcaaccgccgccgctacctcaacgcacgtgccacattgcgtgaactactgcacctgggcaccttgcccgtcgtcaacgaaaacgacaccgtctccgtcgatgaactcaaactgggcgacaacgacaacctggcagccattgttgccgcactgattgatgcccaagccctgtttatcgccaccgatattgacggcttatacaccaccgacccacgccaccatcccgacgcacagcccctgcatgaagtccgcaccctgacccctgaacacctcgccatggctggtgacagcagcagcaccgttggcaccggcggcatgcgtaccaaactcgaagccgcacttaaagccggcgccgctggcattgacacctacctatttaacggccgcagcagcgacgttgtccgcggactcgcacaacaccgcctccgcggcacccgcatccatcccacctgtaccccgattgccgcccgtaaatattggttgcgtcacgccccagtcgagcctggcgcgatcctcatcgatgccggtgccgccgccgccttggcacaacaaggcgcttccctacttccgggcggcgttttgagtgccgaaggcgacttccgccgcggcgatatgatccagatagccacccgcagcccagatcaccccccacaccccctggcacgcggacttgtccaatactcagccgccgatgtccgccgcattgccggttgccattcccgcgatattcagcccctccttggatacacctatggcgacaccatcgttcaccgtgatgacctcgtcctcctctga

SEQ ID NO: 645 - protein, 384 aa, Xylella fastidiosa
MTGTPPPSRFPEQPIPPWRRAVLKVGSSLLAAAGGGLSPRFALDLAHFVSANITAGRQLVIVSSGAVAAGRALIPPLPESGGALAARQALAALGQAQLIALWQRFFDRPVAQVLLTHDDLRNRRRYLNARATLRELLHLGTLPVVNENDTVSVDELKLGDNDNLAAIVAALIDAQALFIATDIDGLYTTDPRHHPDAQPLHEVRTLTPEHLAMAGDSSSTVGTGGMRTKLEAALKAGAAGIDTYLFNGRSSDVVRGLAQHRLRGTRIHPTCTPIAARKYWLRHAPVEPGAILIDAGAAAALAQQGASLLPGGVLSAEGDFRRGDMIQIATRSPDHPPHPLARGLVQYSAADVRRIAGCHSRDIQPLLGYTYGDTIVHRDDLVLL

SEQ ID NO: 646 - DNA, 1155 bp, Xylella fastidiosa
  CDS (1)..(1155): transl_table=11
atgaccggcatccctcccccctcccgcttccccgaacaacccatccccccgtggcgccgcgccgtcctcaaagtgggtagcagcctcctcgccgccgatggcggcggcctttccccccgctttgccttggacttagcacacttcgtctccgccaacatcaccgccggacgccaactcgtcatcgtctcctctggcgctgtcgccgctggtcgtgccctgatacccccactgcccgaatccggcggcgctctcgccgcccgccaagccttagctgcccttggacaagcacaactcatcgcactgtggcaacgcttcttcgaccgccccgttgcccaggtcctcctgacccacgacgacctccgcaaccgccgtcgctacctcaacgcacgtgccacattgcgtgaactactgcacctgggcaccttgcctgtcgtcaacgaaaacgacaccgtctccgtcgatgaactcaaactaggcgacaacgacaacctggcagccattgttgccgcactgattgatgcccaagccctgtttatcgccaccgatattgacggcttatacaccaccgacccacgccaccattctgacgcacagcccctgcatgaagtccgcaccctgacccctgaaaaccttgccatggctggtgacagcagcagcaccgttggcaccggcggtatgcgtaccaaacttgaagcagcacttaaagccggcgccgctggcattgacacctacctatttaacggccgcagcagcgacgttgtccgcggactcgcacaacaccgcctccgcggcacccgcatccatcccacctgtaccccgattgccgcccgtaaatattggttgcgtcacgccccagtggagcccggcgcgatcctcatcgatgccggtgccgccgctgccttggcacaacaaggcgcttccctacttccgggcggcgttttgagtgccgaaggcgacttccgccgcggcgatatgatccagatagccacccgcagcccagatcacccctcccaccccctggcacgcggacttgtccaatactcagccgccgatgtccgccgcattgccggttgccattcccgcgatattcaaaccctccttggatacacctatggcgacacaatcgttcaccgtgatgacctcgtcctcctctga

SEQ ID NO: 647 - protein, 384 aa, Xylella fastidiosa
MTGIPPPSRFPEQPIPPWRRAVLKVGSSLLAADGGGLSPRFALDLAHFVSANITAGRQLVIVSSGAVAAGRALIPPLPESGGALAARQALAALGQAQLIALWQRFFDRPVAQVLLTHDDLRNRRRYLNARATLRELLHLGTLPVVNENDTVSVDELKLGDNDNLAAIVAALIDAQALFIATDIDGLYTTDPRHHSDAQPLHEVRTLTPENLAMAGDSSSTVGTGGMRTKLEAALKAGAAGIDTYLFNGRSSDVVRGLAQHRLRGTRIHPTCTPIAARKYWLRHAPVEPGAILIDAGAAAALAQQGASLLPGGVLSAEGDFRRGDMIQIATRSPDHPSHPLARGLVQYSAADVRRIAGCHSRDIQTLLGYTYGDTIVHRDDLVLL

SEQ ID NO: 648 - DNA, 1104 bp, Yersinia pestis
  CDS (1)..(1104): transl_table=11
atgagtggcagccagacattggttgtgaaattggggacgagtgtactgaccgggggttcccgccgtcttaaccgtgcccatattgttgaattggtgcgtcaatgtgcccagcaacacgcaaaaggtcatcgtattgttattgtcacctctggggcgattgctgcgggtcgtgaacatttagggtatccagagttgcccgccactattgcctcgaaacaattgctagccgcggttgggcaaagccggttaattcagctctgggaacaactgttttcaatttatggcattcatatcggccagatgctgctaacccgcgcagatttagaggatcgtgagcgttttcttaatgcccgcgataccatgaatgcgttgcttgataaccgcattgtaccggtgatcaatgagaacgacgccgtcgctactgctgaaatcaaagtgggcgataacgataatctctccgcattggcggccattttggccagtgcagataagctactgttgttgaccgatcaggcggggttgtacaccgctgatccgcgtaacaatccagaagcggagttaattcgcgaagtgcatggcattgatgatgtcctgcgcgggatggccggagacagcgtttcggggctcgggacggggggcatggcgactaaactgcaagcggcggatgtcgcgtgccgtgcgggtattgatgtggtgattgccgcaggtagccaggtgggtgtgattgccgatgtgattgacggtacgccagtcggtacccgtttccactcattggaaacaccattagaaaaccgtaaacgttggatttttggtgcgccaccggcaggtgaaatcacagtggacgacggtgctgtatttgcgatcatggaacggggcagttcgctgctgccaaaaggcattcgcagcgttaaaggggacttctcccgtggtgaagtgatccgtatccgtaatctcaatgggcgggatttagcacacggtgtttcacgctataacagtgatgcattgcgcatgttagcggggcatcactcgcaacaaatcagtgaaatcctcggatatgaatacggcccggtggctgttcatcgtgatgatatgattgtcagctaa

SEQ ID NO: 649 - protein, 367 aa, Yersinia pestis
MSGSQTLVVKLGTSVLTGGSRRLNRAHIVELVRQCAQQHAKGHRIVIVTSGAIAAGREHLGYPELPATIASKQLLAAVGQSRLIQLWEQLFSIYGIHIGQMLLTRADLEDRERFLNARDTMNALLDNRIVPVINENDAVATAEIKVGDNDNLSALAAILASADKLLLLTDQAGLYTADPRNNPEAELIREVHGIDDVLRGMAGDSVSGLGTGGMATKLQAADVACRAGIDVVIAAGSQVGVIADVIDGTPVGTRFHSLETPLENRKRWIFGAPPAGEITVDDGAVFAIMERGSSLLPKGIRSVKGDFSRGEVIRIRNLNGRDLAHGVSRYNSDALRMLAGHHSQQISEILGYEYGPVAVHRDDMIVS

SEQ ID NO: 650 - DNA, 1194 bp, Zymomonas mobilis
  CDS (1)..(1194): transl_table=11
atggtcgccgatctaacttctgatatttcagaatcccaagagcaagaaacagaaactaactctgccaataacaacggtgcggttttccgaccggaaaactgcccgcgactggttataaaaattggttcttctttgctcgttgaccaacgcggtcaagttcgtcgcgattggctgcaaactgtcgcctatgacattgccaaattgcatcaagctggacagcaaatcattgttgtttcctcaggcgctatcgcactgggtgccagacgcttgaacttgccacgcggtggacgggcatccttggaagatgctcaagcctcggcttctgtcggacaaattttgcttagccaatgctgggcagaattgctgggtgcatgcagcttggattcatcccaaattctactgacactggatgatctggaagatcgccgccgctatctgaacgtctcggctacgcttgatcgcctgctttctcttggtgtcgtgccagtcatcaatgaaaatgactcgattgcgaccgcagaaattcgttttggagataatgaccgtctcgctgctcgcatcgggcaggccagccatgcctctggcgttatcctcttttcggatgtggatggcctttacacggccaaccccatgaaagatcccaacgccaaacggattgatcgggtcgaacatatcgacaatagcacagaagctatggctagcagtgattctgcttccggcatgggttctggcggcatggcttccaaggtagaagcggcgcgtatcgccacctattccggcgttaatctcgcgattacaacgggtaaacgcccttccccgctgacgatgtttttggatgatggtgctggcacgctattcacagccgatgaaagcgcttcagctcataaaacatggctggccggacgattaaccgctcatggtcaggtttatatcgatcaaggcgcagtcgaggcactccatgatggaaacagcctgctccctgcgggcgtctgctccatagaaggcaagttcaaccgcggtgacgtggtcgatatcctcgatcaagaacacaaccttattgcgcggggtctgatcgaatatgacagcgaagattctgcccaaatcacaggcaagcggtcgcaggaaattgctgatattctaggatatgaggccagaacagccctgatccatcgcaatcatatggttatgctatga

SEQ ID NO: 651 - protein, 397 aa, Zymomonas mobilis
MVADLTSDISESQEQETETNSANNNGAVFRPENCPRLVIKIGSSLLVDQRGQVRRDWLQTVAYDIAKLHQAGQQIIVVSSGAIALGARRLNLPRGGRASLEDAQASASVGQILLSQCWAELLGACSLDSSQILLTLDDLEDRRRYLNVSATLDRLLSLGVVPVINENDSIATAEIRFGDNDRLAARIGQASHASGVILFSDVDGLYTANPMKDPNAKRIDRVEHIDNSTEAMASSDSASGMGSGGMASKVEAARIATYSGVNLAITTGKRPSPLTMFLDDGAGTLFTADESASAHKTWLAGRLTAHGQVYIDQGAVEALHDGNSLLPAGVCSIEGKFNRGDVVDILDQEHNLIARGLIEYDSEDSAQITGKRSQEIADILGYEARTALIHRNHMVML

SEQ ID NO: 652 - DNA, 1272 bp, Saccharomyces cerevisiae
  CDS (1)..(1272)
atgacaaaagcttatactatcgttatcaagctgggcagttcgtcgctcgtcgacgagagcacaaaagagccaaagttgtccatcatgacgttaatcgtcgagaccgtgacgaatcttaagcgcatgggccacaaagtgatcatcgtatccagcggcggcattgccgttggtttggacgctctcaacattccgcacaagcctaagcagttgtctgaagtgcaagcgattgccgctgtcggacaaggccgtctcatcgcgcgctggaacatgctgttttcccagtatggcgagcaaacagcgcagatcctgctcacgcgtaacgatatactgcgttggaaccagtacaataacgcacgcaatacaatcaacgaactgctggccatgggtgtcatccctatagtcaacgaaaacgatacgctatccattagcgagatcgagttcggcgataacgacacgctttctgccattaccgctgctcttgtaggggcggatttcctgttcttgctcacagatgtggactgcctatatacagacaatccgcgcactaatccggatgctcgtcctattgttctcgtgccagagctatcagagggccttccgggcgtcaacacttccagtggttcaggctccgaggttggcacgggcggaatgcgcaccaaactcatagccgccgacctcgcctctaatgccggtatcgagactattgtgatgaagagcgaccgtccagagtacgtcccgaagatcgttgactacattcagcatcacttccgccctccgcgccatatcggaaacggcacacagcagcagtttctcgatcttcaggatacggagctcgaacagttgcgtcgctacgatgttcccatgcacaccaagttcttagctaatgacaacaaacacaagcttaagaacagggaattttggattctgcacgggctcattaccaagggcgccattatcatcgacgagaacagctatgataaacttttgtcaaaggatatggctagtctgactccaaacgccgtgatcgaagtccgagacaacttccacgaacttgaatgcgttgatctcaaaataggccagcggttacccaatggcgaattggatatctcgaagccgattcagtctgttggatgcgtccgctccaattatacgagtctggagcttgcgaagatcaagggcttacccagtgagaagattcacgatgttttgggctacagtgtgagtgaatacgtagcacatagagaaaacatcgctttccctccgcaattttga

SEQ ID NO: 653 - protein, 423 aa, Saccharomyces cerevisiae
MTKAYTIVIKLGSSSLVDESTKEPKLSIMTLIVETVTNLKRMGHKVIIVSSGGIAVGLDALNIPHKPKQLSEVQAIAAVGQGRLIARWNMLFSQYGEQTAQILLTRNDILRWNQYNNARNTINELLAMGVIPIVNENDTLSISEIEFGDNDTLSAITAALVGADFLFLLTDVDCLYTDNPRTNPDARPIVLVPELSEGLPGVNTSSGSGSEVGTGGMRTKLIAADLASNAGIETIVMKSDRPEYVPKIVDYIQHHFRPPRHIGNGTQQQFLDLQDTELEQLRRYDVPMHTKFLANDNKHKLKNREFWILHGLITKGAIIIDENSYDKLLSKDMASLTPNAVIEVRDNFHELECVDLKIGQRLPNGELDISKPIQSVGCVRSNYTSLELAKIKGLPSEKIHDVLGYSVSEYVAHRENIAFPPQF

SEQ ID NO: 654 - DNA, 2154 bp, Arabidopsis thaliana
  CDS (1)..(2154)
atggaggagctagatcgttcacgtgcttttgccagagacgtcaaacgtatcgtcgttaaggttgggacagcagttgttactggaaaaggtggaagattggctcttggtcgtttaggagcactgtgtgaacagcttgcggaattaaactcggatggatttgaggtgatattggtgtcatctggtgcggttggtcttggcaggcaaaggcttcgttatcgacaattagtcaatagcagctttgcggatcttcagaagcctcagactgaacttgatgggaaggcttgtgctggtgttggacaaagcagtcttatggcttactatgagactatgtttgaccagcttgatgtgacggcagctcaacttctggtgaatgacagtagttttagagacaaggatttcaggaagcaacttaatgaaactgtcaagtctatgcttgatttgagggttattccaattttcaatgagaatgatgctattagcacccgaagagccccatatcaggattcttctggtattttctgggataacgatagcttagctgctctactggcgttggaactgaaagctgatcttctgattcttctgagcgatgttgaaggtctttacacaggccctccaagtgatcctaactcaaagttgatccacacttttgttaaagaaaaacatcaagatgagattacattcggcgacaaatcaagattagggagagggggtatgactgcaaaagtcaaagctgcagtcaatgcagcttatgctgggattcctgtcatcataaccagtgggtattcagctgagaacatagataaagtcctcagaggactacgtgttggaaccttgtttcatcaagatgctcgtttatgggctccgatcacagattctaatgctcgtgacatggcagttgctgcgagggaaagttccagaaagcttcaggccttatcttcggaagacaggaaaaaaattctgcttgatattgccgatgcccttgaagcaaatgttactacaatcaaagctgagaatgagttagatgtagcttctgcacaagaggctgggttggaagagtcaatggtggctcgcttagttatgacacctggaaagatctcgagccttgcagcttcagttcgtaagctagctgatatggaagatccaatcggccgtgttttaaagaaaacagaggtggcagatggtcttgtcttagagaagacctcatcaccattaggcgtacttctgattgtttttgaatcccgacctgatgcacttgtacagatagcttcacttgccatccgtagtggaaatggtcttctgctgaagggtggaaaggaggcccggcgatcaaatgctatcttacacaaggtgatcactgatgcaattccagagactgttgggggtaaactcattggacttgtgacttcaagagaagagattcctgatttgcttaagcttgatgacgttatcgatcttgtgatcccaagaggaagcaacaagcttgttactcagataaaaaatactacaaaaatccctgtgctaggtcatgctgatggaatctgtcatgtatatgtcgacaaggcttgtgatacggatatggcaaagcgcatagtttctgatgcaaagttggactatccagcagcctgtaatgcgatggaaacccttcttgtgcataaggatctagagcagaatgctgtgcttaatgagcttatttttgctctgcagagcaatggagtcactttgtatggtggaccaagggcaagtaagatactgaacataccagaagcacggtcattcaaccatgagtactgtgccaaggcttgcactgttgaagttgtagaagacgtttatggtgctatagatcacattcaccgacatgggagtgcacacacagactgcattgtgacagaggatcacgaagttgcagagctattccttcgccaagtggatagcgctgctgtgttccacaacgccagcacaagattctcagatggtttccgatttggacttggtgcagaggtgggggtaagcacgggcaggatccatgctcgtggtccagtcggggtcgaaggattacttacaacgagatggataatgagaggaaaaggacaagttgtcgacggagacaatggaattgtttacacccatcaggacattcccatccaagcttaa

SEQ ID NO: 655 - protein, 717 aa, Arabidopsis thaliana [sequence omitted]

SEQ ID NO: 656 - DNA, 2181 bp, Arabidopsis thaliana
  CDS (1)..(2181)
atgacggagatcgatcgttcacgcgcgttcgccaaagacgttaagcgtatcgtcgtcaaggttgggactgcagttgttactgggaaaggtggaagattggctcttggacgtttaggagctatctgtgaacagcttgcggagttaaactcagatggatttgaggtcattttggtgtcatctggtgccgttggtcttggtcgacaaaggcttcgatacagacaattagtcaacagcagttttgcagatttacagaagccacaaatggaacttgatgggaaggcttgtgctggtgttgggcagagcagtctcatggcttactatgagactatgtttgaccagttggatgtgacggttgctcaaatgcttgtgaccgatagcagttttagagataaggatttcaggaagcaacttagtgaaactgtcaaagcgatgctgaggatgagggttattccagttttcaatgagaatgatgctataagcactcgcagagccccctacaaggattctactggtatattttgggataatgacagcttagccgctcttctgtcgctagagctgaaagctgatcttttgattcttctaagtgatgttgagggcctttacactggccctccaagtgattctacctcaaaattaatacacacattcattaaagaaaaacaccaggacgagattacttttggcgaaaagtccaaattaggacgagggggtatgactgcaaaagttaaagctgctgttaatgcagcttatggtggcgttcctgttatcataaccagtggatatgcagctgagaatataagtaaagtccttagaggactgcgtgttggtaccctgttccatcaagatgctcatttatgggctccggtcgtagatactacttctcgtgacatggcagttgctgcaagggaaagctcaagaaagcttcaggccttatcttcagaagataggaaacaaattctacacgacattgccaatgcccttgaagtaaatgagaaaacaattaaagctgagaatgatttagatgttgctgcagcacaagaagctggatatgaagagtctttggtagctcgcttagttatgaagcctgggaagatctcaagccttgcagcttccgttcgccagctagccgaaatggaagatccaataggccgtgtattaaagaaaactcaggttgcagatgatcttattttagagaagacctcatcaccaataggtgttcttctgattgtttttgaatcccggcctgatgcacttgttcagatagcttcgcttgcaatccggagtggaaatggtcttctgctgaagggtggaaaggaggctcgtcgatcaaatgctatcttacacaaggtgatcactgatgcaattccggagactgttggaggtaaactcataggacttgtgacctcaagagaggagattcctgatttgctcaagcttgatgacgttattgatcttgtgatcccaagaggcagcaacaagcttgtttctcaaataaaaaactcgacgaaaatcccagtgctaggccatgctgatggaatctgtcatgtatatgttgataagtctggtaaactggacatggcaaagcgcattgtttccgatgcaaagttggactatccagcagcctgtaatgcgatggaaacccttcttgtacataaagatttggagcagaatggttttctcgatgatcttatttatgttctgcaaaccaaaggcgtcactttgtatggtgggccaagagcaagtgcaaaactgaatattccggaaacaaaatcatttcaccacgagtacagttccaaggcctgcaccgttgaaattgtagaagacgtatatggtgctatagatcatattcaccaacatggaagtgcacacactgattgcatagtgacggaagatagtgaagtagcagaaatattcctccgccaagtggacagtgctgctgttttccacaatgcaagcacaagattctctgatggttttaggttcggacttggtgctgaggtgggaataagcacaagcaggattcatgcccgtggtccagttggagttgaaggattattgacaacaagatggataatgagaggaaagggacaagttgtggatggagacaatggaatcgtttacacccataaggatcttcctgtcttacaaaggacagaggctgttgagaatggaatttag

SEQ ID NO: 657 - protein, 726 aa, Arabidopsis thaliana
MTEIDRSRAFAKDVKRIVVKVGTAVVTGKGGRLALGRLGAICEQLAELNSDGFEVILVSSGAVGLGRQRLRYRQLVNSSFADLQKPQMELDGKACAGVGQSSLMAYYETMFDQLDVTVAQMLVTDSSFRDKDFRKQLSETVKAMLRMRVIPVFNENDAISTRRAPYKDSTGIFWDNDSLAALLSLELKADLLILLSDVEGLYTGPPSDSTSKLIHTFIKEKHQDEITFGEKSKLGRGGMTAKVKAAVNAAYGGVPVIITSGYAAENISKVLRGLRVGTLFHQDAHLWAPVVDTTSRDMAVAARESSRKLQALSSEDRKQILHDIANALEVNEKTIKAENDLDVAAAQEAGYEESLVARLVMKPGKISSLAASVRQLAEMEDPIGRVLKKTQVADDLILEKTSSPIGVLLIVFESRPDALVQIASLAIRSGNGLLLKGGKEARRSNAILHKVITDAIPETVGGKLIGLVTSREEIPDLLKLDDVIDLVIPRGSNKLVSQIKNSTKIPVLGHADGICHVYVDKSGKLDMAKRIVSDAKLDYPAACNAMETLLVHKDLEQNGFLDDLIYVLQTKGVTLYGGPRASAKLNIPETKSFHHEYSSKACTVEIVEDVYGAIDHIHQHGSAHTDCIVTEDSEVAEIFLRQVDSAAVFHNASTRFSDGFRFGLGAEVGISTSRIHARGPVGVEGLLTTRWIMRGKGQVVDGDNGIVYTHKDLPVLQRTEAVENGI

SEQ ID NO: 658 - DNA, 2208 bp, Oryza sativa
  CDS (1)..(2208)
atggggagaggagggatcggcggcgcggggctggtggcggcggtcgcgaaggcggacgtggagaacaccgactccacccgcggcttcgtcaaggacgtgaagcgcatcatcatcaaggtcggcaccgctgttgtgactgggccgaatggccggttggctatgggcaggctcggtgctctgtgtgaacaggtgaagcagctaaattttgaggggtacgaggtgattctggtcacctctggtgctgttggtgttgggaggcagaggctcaagtaccggaagctcgtcaatagcagtttcgctgatctgcagaacccacagatggacatggacgggaaggcctgcgctgccgtcggtcagagtgtgctgatggcgatctatgacacgttatttagccagcttgacgtaacatcatctcagcttcttgttacggatcgtgattttatggatccaagttttgggaaccagctccgcgagactgttaattctctgttagatctcaaggttataccagtatttaatgagaatgacgccatcagtaccaggaggcaaccatacgaggattcatctggcatattctgggataacgatagtttggccagactgttagcgcaagaacttaaagctgatctccttatcatgctcagtgatgtggaggggctctatagcggtccacctagcgatccacaatcgaagattatccacacatacgtccatgaacaacatgggaagttaattagctttggggagaaatctcgtgtgggaagaggtggaatgcaagctaaagtagcagctgcttttactgcttcatcaaaaggaatacctgttgtaattgccagtggatttgcaatcgatagcattattaaggtcatgcgaggagagaaaatcggtacgcttttccatagggaagcaaaccagtggggttgttccaaggaagcaacagcgcgtgagatggccgttgctgcaagagattgctccagacatctacagaaattgtcgtctgaggagcgtaagaagattttgctagacatcgccgatgctctagaagcaaatgaagatctaattacatccgagaaccaagctgatctggatttggcgcaagatattggttacgataaatcattggttgctcggatgaccataaagccaggaaagataaaaagcctcgcaggatcaattcgtgaaatcgctgatatggaggaccctatttcccatacactgaaaagaacagaggttgctaaagatcttgtttttgagaaaacatattgcccattgggtgttctcctaattatttttgagtcccgtcctgatgccttggtacagattgcatctttagcaatccgaagtggaaatggtcttctcttgaaaggaggaaaagaagctatgagatcaaacacaatactgcataaggtcataactggtgcaattccagatgttgttggtaaaaaacttattggcctagtgaaaaacaaagatgaaattgctgatttgctcaagcttgatgatgtgattgatcttgtaataccaagaggtagcaataagctcgtttcccagatcaaagcagcaaccaagattcctgttcttggtcatgctgacggtatctgccatgtttatattgacaaatcagctgacatggacatggcaaaacgtattgtattggacgcaaaggttgattatccagcagcgtgtaatgccatggaaacgttacttgttcataaagatctgaacaggacagaaggccttgacgatttattggtggagcttgaaaaggaaggggtagttatctatggcgggcctgttgcacatgacactttgaaactaccaaaggtagattcatttcatcatgagtataactcaatggcatgcaccctcgaatttgttgatgatgtgcagtcagcaattgaccatataaatcgctatggaagtgcacacacagattgcattatcactactgatggaaaggcagcagagacttttctacagcaagttgatagtgctgcggtattccataatgcaagcacacggttctgtgatggggctcgctttggtctaggtgctgaggttggcataagcacagggcgcatacatgctcgggggcctgttggcgttgatggactcctaacaactcgatgcattttacgaggaagtggacaagtagtgaacggcgacaagggagttgtttacacccacagggagctccctttgcagtga

SEQ ID NO: 659 - protein, 735 aa, Oryza sativa
MGRGGIGGAGLVAAVAKADVENTDSTRGFVKDVKRIIIKVGTAVVTGPNGRLAMGRLGALCEQVKQLNFEGYEVILVTSGAVGVGRQRLKYRKLVNSSFADLQNPQMDMDGKACAAVGQSVLMAIYDTLFSQLDVTSSQLLVTDRDFMDPSFGNQLRETVNSLLDLKVIPVFNENDAISTRRQPYEDSSGIFWDNDSLARLLAQELKADLLIMLSDVEGLYSGPPSDPQSKIIHTYVHEQHGKLISFGEKSRVGRGGMQAKVAAAFTASSKGIPVVIASGFAIDSIIKVMRGEKIGTLFHREANQWGCSKEATAREMAVAARDCSRHLQKLSSEERKKILLDIADALEANEDLITSENQADLDLAQDIGYDKSLVARMTIKPGKIKSLAGSIREIADMEDPISHTLKRTEVAKDLVFEKTYCPLGVLLIIFESRPDALVQIASLAIRSGNGLLLKGGKEAMRSNTILHKVITGAIPDVVGKKLIGLVKNKDEIADLLKLDDVIDLVIPRGSNKLVSQIKAATKIPVLGHADGICHVYIDKSADMDMAKRIVLDAKVDYPAACNAMETLLVHKDLNRTEGLDDLLVELEKEGVVIYGGPVAHDTLKLPKVDSFHHEYNSMACTLEFVDDVQSAIDHINRYGSAHTDCIITTDGKAAETFLQQVDSAAVFHNASTRFCDGARFGLGAEVGISTGRIHARGPVGVDGLLTTRCILRGSGQVVNGDKGVVYTHRELPLQ

SEQ ID NO: 660 - DNA, 2151 bp, Oryza sativa
  CDS (1)..(2151)
atggcgagcgtcgacccgtcccggagcttcgtgagggacgtgaagcgcgtcatcatcaaggtgggcactgcagttgtctccagacaagatggaagattggctttgggcagggttggagctctgtgcgagcaggttaaggaactgaactctttaggatacgaagtgattttggtcacctcaggtgctgttggagtggggcgacagcgacttaggtaccggaagcttgtcaatagcagctttgctgatctgcaaaagccacagatggagttagatggaaaggcttgtgccgctgttggtcagagtggactgatggctctttacgatatgttgtttaaccaactggatgtctcgtcatctcaacttcttgtcaccgacagtgattttgagaacccaaagttccgggagcaactcactgaaactgttgagtcattattagatcttaaagttataccaatatttaatgaaaatgatgccatcagcactagaaaggctccatatgaggattcatctggtatattctgggataatgacagtttagcaggactgttggcactggaactgaaagctgatctccttattctgctcagtgatgtggatgggttgtatagtggtccaccaagtgaaccatcatcaaaaatcatacacacttatattaaagaaaagcatcagcaagaaatcacttttggagacaaatctcgtgtaggtagaggaggcatgacagcaaaagtgaaggctgctgtcttggcttcaaatagcggcacacctgtggttattacaagtgggtttgaaaatcggagcattcttaaagttcttcatggggaaaaaattggtactctctttcacaagaatgcgaatttgtgggaatcatctaaggatgttagtactcgtgagatggctgttgccgcaagagattgttcaaggcatctacagaatttgtcatcagaggaacgaaaaaagatattgctagatgttgcagatgctttggaggcaaatgaggatttaataaggtctgagaatgaagctgatgtagctgcggcccaagttgctggatatgagaagcctttggttgctagattgactataaaaccaggaaagatagcaagccttgcaaaatctattcgtacccttgcaaatatggaagaccctataaaccagatacttaaaaagacagaggttgctgatgatttagttcttgagaaaacatcttgcccattaggtgttctcttaattgtttttgagtcccgacctgatgccttggttcagattgcatctttggcaattcgaagtggtaatggtcttctcctaaaaggtggaaaagaagctatcagatcaaacacgatattgcataaggttataactgatgctattcctcgtaatgttggtgaaaaacttattggccttgttacaactagagatgagatcgcagatttgctaaagcttgatgatgtcattgatcttgtcattccaagaggaagtaataagcttgtctctcaaatcaaggcgtcaactaagattcctgttcttgggcatgctgatggtatatgccacgtatatattgacaaatcagctgacatggatatggcaaaacatattgtaatggatgcaaaaattgattacccagcagcctgcaatgcaatggagaccttactagttcataaggatcttatgaagagtccaggccttgacgacatattagtagcactaaaaacagaaggagttaatatttatggtggacctattgcgcacaaagctctgggatttccaaaagctgtttcatttcatcatgagtatagttctatggcctgcactgttgagtttgttgatgatgttcaatcagcaattgaccatattcatcgttatggaagtgctcatacagattgtatcgtcactacagatgataaggtagcagagacttttctacgcagagttgatagtgctgctgtatttcataatgcaagtacgagattctctgatggggctcgttttggattgggtgctgaggttggcataagcacagggcgtatccatgcccgtggaccagtgggtgttgaaggtctcttaactacacgatggatcttgcgagggcgtgggcaagtggtgaatggtgacaaggatgtcgtgtacacccataagagtcttcctttgcaatga

SEQ ID NO: 661 - protein, 716 aa, Oryza sativa
MASVDPSRSFVRDVKRVIIKVGTAVVSRQDGRLALGRVGALCEQVKELNSLGYEVILVTSGAVGVGRQRLRYRKLVNSSFADLQKPQMELDGKACAAVGQSGLMALYDMLFNQLDVSSSQLLVTDSDFENPKFREQLTETVESLLDLKVIPIFNENDAISTRKAPYEDSSGIFWDNDSLAGLLALELKADLLILLSDVDGLYSGPPSEPSSKIIHTYIKEKHQQEITFGDKSRVGRGGMTAKVKAAVLASNSGTPVVITSGFENRSILKVLHGEKIGTLFHKNANLWESSKDVSTREMAVAARDCSRHLQNLSSEERKKILLDVADALEANEDLIRSENEADVAAAQVAGYEKPLVARLTIKPGKIASLAKSIRTLANMEDPINQILKKTEVADDLVLEKTSCPLGVLLIVFESRPDALVQIASLAIRSGNGLLLKGGKEAIRSNTILHKVITDAIPRNVGEKLIGLVTTRDEIADLLKLDDVIDLVIPRGSNKLVSQIKASTKIPVLGHADGICHVYIDKSADMDMAKHIVMDAKIDYPAACNAMETLLVHKDLMKSPGLDDILVALKTEGVNIYGGPIAHKALGFPKAVSFHHEYSSMACTVEFVDDVQSAIDHIHRYGSAHTDCIVTTDDKVAETFLRRVDSAAVFHNASTRFSDGARFGLGAEVGISTGRIHARGPVGVEGLLTTRWILRGRGQVVNGDKDVVYTHKSLPLQ

SEQ ID NO: 662 - DNA, 2504 bp, Glycine max
  CDS (67)..(2214)
cggctacactctctttcttctctgccaaccacactgaacaacaaacacagtctgtttggtcagaatatggagaacacagatccttgtagacattttctcaaggatgttaagcgcatcataatcaaggttgggactgctgtggtcactcgccaagatggaaggttagctgttggaaaattaggggcactctgtgagcagattaaggagctgaattctcttggttatgagattattttggtgtcatcaggtgctgttggccttggtcgccaaaggcttagatacagaaaattaattaacagcagctttgctgaccttcagaagccgcaagttgaacttgatggcaaggcttgtgctgctgttggacaaaacagccttatggctctttatgatgttttgtttagtcagctggatgtgacatctgctcagcttcttgtgacggacaatgattttagagacaaagatttcagaatgcagctcagcgaaactatgaaatcattgttagcattaaaagttattcccatattcaacgagaacgatgcagttagtactaggaaagctccatatgaggattcttctggcatattttgggataatgacagtttatcagctttattggcattggaattaaaagctgatcttcttattttgttgagtgatgtagagggtctctatagtggccctccaagtgatccacgttcaaaacttattcatacatacattaaggaaaagcatcaaagtgaaattacttttggagacaagtctagagtgggaagaggtggaatgactgctaaagtaaaggcttctattcatgcagctgaagctggcattcctgttatcattactagtggttatgcagctgaaaatatcattaaagttctccaaggacaacggattggaaccctcttccataaagatgcacataaatgggccccggtaaaagaggttgatgctcgtgagatggcagttgcagctagggactgttccagacggcttcaggccttatcttcagaagagaggaaacaaattttgctaaaaatagctgatgccctggaagcacatcaaaatgagatcaggattgaaaatgaagctgatgttgctgatgcaaaagaagcaggatatgaaaaatccttggttgctagactggttttaaagaatgagaagcttgcaagccttgctaacaacattcgaattattgcaaacatggaagatccaattggtcgagtgttaaaacgaactgagcttgcagaggggctgattttggagaaaacatcatcttctttaggagttcttttaattgtttttgagtctcgccctgatgcactagtacagatagcttctttggcaatccgaagtgggaatgggcttctcttgaaaggaggcaaggaggctaagcgatcaaatgcaattttgcacaaagtaattactgaagccataccagatattgttggctcaaaacttattggacttgtgacatcaagagcagaaattcctgagctacttaagttggatgatgtaattgatctagtgattccaagaggcagcaacaaacttgtcactcagatcaagagttccactaaaattcctgtcctgggtcatgcagatggaatttgtcatgtctatgttgataaatctgctgatctggagatggcaaggcggattgtactagatgcaaaaatagactatccagcaggctgcaatgccatggaaactcttcttgttcacaaggacttggtagagaaaggttggctcaatagtattattattgacctacggacagaaggtgttacattgtatggaggacccaaggcaagtcctttgttaaatattccaatggctcgtatgttacatcatgagtacaattcgttggcatgcacagttgaaattgtggatgatgtttatgcagctattgatcatataaatctttatggaagtgcacatactgattccgttgttgcagaagatcatgaagtagccaatgtgtttctacgccaagtagacagtgctgctgttttccacaatgctagtacaagattcagtgatggggcacgatttggactaggtgcagaggttggaataagtacaagcaggattcatgctcggggtccagtaggagttgatggattgttaacaaccagatggattctcaaaggaagtggacaaatagtggatggtgacaaagcagttaactacactcacagagacctttctatatgattcatgattgttgcaagtaaaaattcatggattggagggatgggagaaaaggagggttgctaggctgtgctttattttctctagagtggggctaaagttgtacaattcagtggaggagggatatttatgctatctggtgctgctgcttttacgttcaagatgttatacaagggaattgctattctccccaacgttagaaaattgatgttcattgtgtgagttttttttttgctataaatttaaacgtcagtataaatatttattataaaatcagtaaaaaaaaaaaaaaa

SEQ ID NO: 663 - protein, 715 aa, Glycine max
MENTDPCRHFLKDVKRIIIKVGTAVVTRQDGRLAVGKLGALCEQIKELNSLGYEIILVSSGAVGLGRQRLRYRKLINSSFADLQKPQVELDGKACAAVGQNSLMALYDVLFSQLDVTSAQLLVTDNDFRDKDFRMQLSETMKSLLALKVIPIFNENDAVSTRKAPYEDSSGIFWDNDSLSALLALELKADLLILLSDVEGLYSGPPSDPRSKLIHTYIKEKHQSEITFGDKSRVGRGGMTAKVKASIHAAEAGIPVIITSGYAAENIIKVLQGQRIGTLFHKDAHKWAPVKEVDAREMAVAARDCSRRLQALSSEERKQILLKIADALEAHQNEIRIENEADVADAKEAGYEKSLVARLVLKNEKLASLANNIRIIANMEDPIGRVLKRTELAEGLILEKTSSSLGVLLIVFESRPDALVQIASLAIRSGNGLLLKGGKEAKRSNAILHKVITEAIPDIVGSKLIGLVTSRAEIPELLKLDDVIDLVIPRGSNKLVTQIKSSTKIPVLGHADGICHVYVDKSADLEMARRIVLDAKIDYPAGCNAMETLLVHKDLVEKGWLNSIIIDLRTEGVTLYGGPKASPLLNIPMARMLHHEYNSLACTVEIVDDVYAAIDHINLYGSAHTDSVVAEDHEVANVFLRQVDSAAVFHNASTRFSDGARFGLGAEVGISTSRIHARGPVGVDGLLTTRWILKGSGQIVDGDKAVNYTHRDLSI

SEQ ID NO: 664 - DNA, 3145 bp, Zea mays
  CDS (495)..(2648)
ctccccttgctggccaaatcgatcgctccccttcaggctccaggctccggagcttgctggcattcaccgacacaaccggggttaaggaggcctaaccttcgactggaggaacggtgatcctacaagacctgaacgagatgcgctgctttggacagaccctaccgaggacaactgccgtacatgagaggggcagtcgtaggacagccaccatcccttcccggattgcctgatcctcatggcgaggaggctgagggactcctcctgatggggactggaggccattcggctcgaggttgccatttttgttccctcacccagtccgtctcaccacttcaaaaaccctctcctctctcatccgccttcctggcgattgcggcgacgaggtgacgatagagctgcccccgcaaggaaaacggacaagagaggcggacgctgataggcaaaggagacggacgaccaagagcggcgtcgatctaaaagcgttggcggcggccatggccaccgcggaccggacccggactttcatgaaggacgtcaaacgcgtcatcatcaaggtgggcactgcagtcgtcacgaggggtgatgatgggcgactggctgtgggccggttggggtgtctttgtgagcaggtaaaagagctgaatgtcttaggatacgaggtgatccttgtgacctcaggtgctgttggtgtggggaagcagaggctcaagtacaggaagcttgtcaatagcagctttgctgatctgcaaaagccacagacggagctggatggaaaggcttgcgctgctgttggtcagagtggcctcatggctctttatgatatgctatttacccaacttgatgtgtcctcctcgcaacttcttgtgacagatagtgattttgagaatccaaactttcgggagaggctctgtgaaactgttgagtcactattagaccttaaagttgtaccaatatttaatgaaaatgatgccatcagcactagaaaggctccatatgaggattcatctggtatattctgggataatgacagtttagctggtcttttggctattgaacttaaagcagatctccttgttctactaagtgacgtagatggtctatacagcggtccaccaagcgaaccgggatcaaagatcattcatacctacatcaaagataaacattacagtggaataacttttggggataagtcacgtgtaggtagaggaggaatgacagctaaagtgaaggctgcttttgtggcttcgaacagtggcacacctgttgttattacaagtggatttgcatctcagagcattgttagagttctccaaggagagaagattggtactctcttccataaggatgcaagtctgtgggagccatccaaggatgttagtgctcgtgagatggctgttgctgcaagagaatgttcaaggcgtctgcagaatttatcatcggatgaacgcaagaaaatattgttagacattgcagatgctttggaacaaaatgaggatctaattagaactgaaaatgaagctgatgtatctgcagcacaagatgctggatatcagaaatctttggttgatagattgacattgaagccagaaaagatagcaagccttgcgaaatccatacgcactcttgcaaatatggaagacccaatcaaccagatactcaaaagaacagaggttgctgaagacttagtgctcgaaaaaacatcttgccctctgggtgtgctgttgattgtttttgagtccaggcctgatgccttagtccagattgcgtctttagcaattcgaagtggcaatggtcttctcctgaaaggtggaaaagaagccatgagatcgaacacagtattacataaggttataactggcgcaattcctaacaacgtgggtcaaaaacttattggccttggtacaagtagagacgaaatcgctgatttactaaagcttcatgatgtaattgatcttgtcattccaagaggcagcaataagctggtttcgcaaatcaaagcatcaactaagatacctgtcctcggtcatgcggatggtatttgtcatgtatacattgacaaatcagctgacatgaatatggcaaaacgaatagtgatggatgccaaaactgattacccagcagcctgcaatgctatggagacattgcttgttcataaagaccttataaaggctccaggtcttgatgatatactcctatcactcaaaacagaaggagttgctatttatggagggcctgttgcacatgaagtactgtgtattccgaaagcagattcattccatcatgaatatagctctatggcctgcacaattgagttcgttgatgatgtacagtcagcaattaaccatatacatcgttatggaagtgcacatacagattgcattatcaccacagatgataaagtagcagaaacttttctgcgtcaagttgatagtgctgctgtatttcataatgcgagtacacgattctctgatggggctcgttttggattgggtgccgaggttggcataagcacagggcgtatacatgctcgcgggcctgtgggtgttgaaggtctcttaacaacacgctggatcatgcgaggaagtgggcaagtggtgaatggtgacaagaatgttgcatacacccataagaaccttcccttacaatgaggctgtttttgtgcttgatcaggattcgtgtctatccagtgatgtttgatagtttcatcaggcaggagcatagaatggtgaatcttttcgattgaggactgtgaatccatggatgttcagtcattgtttgtgtagacattgtggtgagcttggaggccaccccacctccccaataaagcagtgctgggagtaatagagcactgatgtactgagggtgcctaggttaaacaagaggaaccggttatatttgttttgcggtcgaacacaaacaatttttgttggtgacttgtttcttatgattctacatatttcaaggtttatgtgctgtcctaaaagggggccttgatacccgtacccaattcgccttagtgagtcgtattttggatactgtaggcatactgtaacgacagcaaaagctggctgcagtagccacagctgtactgctgcaaatagctgttactaaaatatcgtgcatcacatgtcggccacaattaccc

SEQ ID NO: 665 - protein, 717 aa, Zea mays
MATADRTRTFMKDVKRVIIKVGTAVVTRGDDGRLAVGRLGCLCEQVKELNVLGYEVILVTSGAVGVGKQRLKYRKLVNSSFADLQKPQTELDGKACAAVGQSGLMALYDMLFTQLDVSSSQLLVTDSDFENPNFRERLCETVESLLDLKVVPIFNENDAISTRKAPYEDSSGIFWDNDSLAGLLAIELKADLLVLLSDVDGLYSGPPSEPGSKIIHTYIKDKHYSGITFGDKSRVGRGGMTAKVKAAFVASNSGTPVVITSGFASQSIVRVLQGEKIGTLFHKDASLWEPSKDVSAREMAVAARECSRRLQNLSSDERKKILLDIADALEQNEDLIRTENEADVSAAQDAGYQKSLVDRLTLKPEKIASLAKSIRTLANMEDPINQILKRTEVAEDLVLEKTSCPLGVLLIVFESRPDALVQIASLAIRSGNGLLLKGGKEAMRSNTVLHKVITGAIPNNVGQKLIGLGTSRDEIADLLKLHDVIDLVIPRGSNKLVSQIKASTKIPVLGHADGICHVYIDKSADMNMAKRIVMDAKTDYPAACNAMETLLVHKDLIKAPGLDDILLSLKTEGVAIYGGPVAHEVLCIPKADSFHHEYSSMACTIEFVDDVQSAINHIHRYGSAHTDCIITTDDKVAETFLRQVDSAAVFHNASTRFSDGARFGLGAEVGISTGRIHARGPVGVEGLLTTRWIMRGSGQVVNGDKNVAYTHKNLPLQ

SEQ ID NO: 666 - DNA, 2592 bp, Zea mays
  CDS (1)..(2235)
  misc_feature (2535)..(2535): n is a, g, c or t
  misc_feature (2536)..(2536): n is a, g, c or t
  misc_feature (2537)..(2537): n is a, g, c or t
  misc_feature (2538)..(2538): n is a, g, c or t
  misc_feature (2539)..(2539): n is a, g, c or t
atggccaccgcagaccagagccgtattttcatgaaggacgtcaaacgcgtcatcatcaagctggggaatcctattcctatctatggaattgaacgtgtccgggaaaaagagggaattgaacgggctgaacgggcccgggaaaaagtgggcactgcagttgtcacgaggcatgatgggcgagtatccacaggcaattttggtgttctttgtgaacaggtgaaagagataaatgctctaggatacgaggtgatcattgtgtcctcaggtgctgttggtgtggggaagcagaggctcaattacaggaagcttgtcaatagcagctttgctgatatgcaaaagccacagacggagctggatggaaaggcttgcgctgccgttggacagagtggcctcatggctctctatgatatgctatttactcaacttgatgtatcctcttcccaacttcttgtgacagacagtgattttgagaatccaaacttcagggagaggcttcgtgaaactgttgagtcactattagatcttaaagttgtaccaatatttaatgaaaatgatgccatcagcaccagaaaggctccatatgaggattcatcgggtatattctgggataatgacagtttagccggtctttcggctagagaacttaaagcagatctccttggtctactaagtgacgtagatggcctatacagcggtccaccaagcgaaccgcgatcaaagatcattcatacctacatcaaagataaacatcacagcggaataacttttggggataagtcacgtgtaggtagaggaggaatgacagctaaagtgaaggctgctctcgtggcttcgaacagtggcacacctgttgttattacaagtggatctgcatctcagagcatcgttagagttctccaaggagagaagattggtactctcttccataaggacgcaagtctgtgggagccatccaaggatgttagtgctcgtgagatggctgttgctgcaagagaatgttcaaggcgtctgcagaatttatcatcggatgaacgcaagaaaatattgctagacatggcagatgctttggaacaaaatgaggatctaattagaaccgaaaatgaagccgatgtagctgcagcacaagatgctggatatcagaaatctttggttgatagattgacactgaagccagaaaagatagcaaccctcgcgaaatccatacgcactcttgcaaatatggaagacccaatcaaccagatactcaaaagaacagaggttgctgaagacttagtgctcgaaaaaacatcttgccctctgggtgtcctgttgattgtttttgagtccaggcctgatgccttagtccagattgcgtctttagcagttcgaagtggcaatggtcttctcctgaaaggtggaaaagaagccatgagatcgaacacagtattacataaggttataactggcgcaattcctgacaacgtgggtcaaaaacttattggccttgttacaagtagagacgaaatcgctgatttactaaagcttcatgatgtcattgatcttgtcattccaagaggcagcaataagctggtttcgcaaatcaaagcatcaactaagatacctgtcctcggtcatgcggatggtatctgtcatgtatacatcgacaaatcagctgacatgaatatggcaaaacgaatagtgatggatgccaaaactgattacccagcagcctgcaatgctatggagacattgcttgttcataaagaccttataaaggctccaggtcttgatgacatactcctatcactcaaaacagaaggagtgcctatctatggacggccgcttccacatgaagtactgtgtattccgaaagcagattcattccatcatgaatatagctctatggcctgcacaattgagttcgttgatgatgtacagtcagcaattaaccatatacatcgttatggaagtgcacatacagattgcattatcaccacagatgataaagtagcagaaacttttctgcggcaagttgatagtgctgctgtatttcataatgcgagtacacgattctctgatggggctcgttttggattgggtgccgaggttggcataagcacagggcgtatacatgctcgcgggcctgtgggtgttgaaggtctcttaacaacacgctggatcatgcgaggaagtgggcaagtggtgaattgtgacaagaatgttgcatacacccataagaaccttcccttacaatgaggtagcagaagcaaactaaacctatgcaactatgcaggctcttcccttacatttatgcttgatcaggattcgtgtctatccagtgatgtttgatagtttcatcaggcaggagcagagaatggtgaatcttttcgattgaggactgtgaatccatggatgttcagtcattgtttgtgtagacattgtggtgagcttggaggccaccccacctccccaataaagcagtgctgggagtaatagagcactgatgtactgagggtgcctaggttagtatttgttttgcggtcgaacacaaacaannnnngttggtgacttgtttcttttgattctacatatttcaaggtttatgtgctgtcc

SEQ ID NO: 667 - protein, 744 aa, Zea mays
MATADQSRIFMKDVKRVIIKLGNPIPIYGIERVREKEGIERAERAREKVGTAVVTRHDGRVSTGNFGVLCEQVKEINALGYEVIIVSSGAVGVGKQRLNYRKLVNSSFADMQKPQTELDGKACAAVGQSGLMALYDMLFTQLDVSSSQLLVTDSDFENPNFRERLRETVESLLDLKVVPIFNENDAISTRKAPYEDSSGIFWDNDSLAGLSARELKADLLGLLSDVDGLYSGPPSEPRSKIIHTYIKDKHHSGITFGDKSRVGRGGMTAKVKAALVASNSGTPVVITSGSASQSIVRVLQGEKIGTLFHKDASLWEPSKDVSAREMAVAARECSRRLQNLSSDERKKILLDMADALEQNEDLIRTENEADVAAAQDAGYQKSLVDRLTLKPEKIATLAKSIRTLANMEDPINQILKRTEVAEDLVLEKTSCPLGVLLIVFESRPDALVQIASLAVRSGNGLLLKGGKEAMRSNTVLHKVITGAIPDNVGQKLIGLVTSRDEIADLLKLHDVIDLVIPRGSNKLVSQIKASTKIPVLGHADGICHVYIDKSADMNMAKRIVMDAKTDYPAACNAMETLLVHKDLIKAPGLDDILLSLKTEGVPIYGRPLPHEVLCIPKADSFHHEYSSMACTIEFVDDVQSAINHIHRYGSAHTDCIITTDDKVAETFLRQVDSAAVFHNASTRFSDGARFGLGAEVGISTGRIHARGPVGVEGLLTTRWIMRGSGQVVNCDKNVAYTHKNLPLQ

SEQ ID NO: 668 - DNA, 2452 bp, Zea mays
  CDS (105)..(2258)
tagagctgcccccgcaaggaaaacggacaagagaggcggaggctgatagggagaggagacggaggaccaagagcggcgtcgatctaaaagcgttggcggcggccatggccaccgcggaccggacccggactttcatgaaggacgtcaaacgcgtcatcatcaaggtgggcactgcagtcgtcacgaggggtgatgatgggcgactggctgtgggccggttggggtgtctttgtgagcaggtaaaagagctgaatgtcttaggatacgaggtgatccttgtgacctcaggtgctgttggtgtggggaagcagaggctcaagtacaggaagcttgtcaatagcagctttgctgatctgcaaaagccacagatggagctggatggaaaggcttgcgctgctgttggtcagagtggcctcatggctctttatgatatgctatttacccaacttgatgtgtcctcctcgcaacttcttgtgacagatagtgattttgagaatccaaactttcgggagaggctctgtgaaactgttgagtcactattagaccttaaagttgtaccaatatttaatgaaaatgatgccatcagcactagaaaggctccatatgaggattcatctggtatattctgggataatgacagtttagctggtcttttggctattgaacttaaagcagatctccttgttctactaagtgatgtagatggtctatacagcggtccaccaagcgaaccgggatcaaagatcattcatacctacattaaagataaacattacagtggaataacttttggggataagtcacgtgtaggtagaggaggaatgacagctaaagtgaaggctgcttttgtggcttcgaacagtggcacacctgttgttattacaagtggatttgcatctcagagcattgttagagttctccaaggagagaagattggtactctcttccataaggatgcaagtctgtgggagccatccaaggatgttagtgctcgtgagatggctgttgctgcaagagaatgttcaaggcgtctgcagaatttatcatcggatgaacgcaagaaaatattgttagacattgcagatgctttggaacaaaatgaggatctaattagaactgaaaatgaagctgatgtatctgcagcacaagatgctggatatcagaaatctttggttgatagattgacattgaagccagaaaagatagcaagccttgcgaaatccatacgcactcttgcaaatatggaagacccaatcaaccagatactcaaaagaacagaggttgctgaagacttagtgctcgaaaaaacatcttgccctctgggtgtgctgttgattgtttttgagtccaggcctgatgccttagtccagattgcgtctttagcagttcgaagtggcaatggtcttctcctgaaaggtggaaaagaagccatgagatcgaacacagtattacataaggttataactggcgcaattcctgacaacgtgggtcaaaaacttattggccttgttacaagtagagatgaaatcgctgatttactaaagcttgatgatgtcattgatcttgtcattccaagaggcagcaataagctggtttcgcaaatcaaagcatcaactaagatacctgtcctcggtcatgcggatggtatttgtcatgtatacattgacaaatcagctgacatgaatatggcaaaacgaatagtgatggatgccaaaactgattacccagcagcctgcaatgctatggagacattgcttgttcataaagaccttataaaggctccaggtcttgatgatatactcctatcactcaaaacagaaggagttgctatttatggagggcctgttgcacatgaagtactgtgtattccgaaagcagattcattccatcatgaatatagctctatggcctgcacaattgagttcgttgatgatgtacagtcagcaattaaccatatacatcgttatggaagtgcacatacagattgcattatcaccacagatgataaagtagcagaaacttttctgcgtcaagttgatagtgctgctgtatttcataatgcgagtacacgattctctgatggggctcgttttggattgggtgccgaggttggcataagcacagggcgtatacatgctcgcgggcctgtgggtgttgaaggtctcttaacaacacgctggatcatgcgaggaagtgggcaagtggtgaatggtgacaagaatgttgcatacacccataagaaccttcccttacaatgaggctgtttttgtgcttgatcaggattcgtgtctatccagtgatgtttgatagtttcatcaggcaggagcagagaatggtgaatcttttcgattgaggactgtgaatccatggatgttcagtcattgtttgtgtagacattgtggtgagcttggaggccaccccacctccccaataaagcagtgctgggagtaat

SEQ ID NO: 669 - protein, 717 aa, Zea mays
MATADRTRTFMKDVKRVIIKVGTAVVTRGDDGRLAVGRLGCLCEQVKELNVLGYEVILVTSGAVGVGKQRLKYRKLVNSSFADLQKPQMELDGKACAAVGQSGLMALYDMLFTQLDVSSSQLLVTDSDFENPNFRERLCETVESLLDLKVVPIFNENDAISTRKAPYEDSSGIFWDNDSLAGLLAIELKADLLVLLSDVDGLYSGPPSEPGSKIIHTYIKDKHYSGITFGDKSRVGRGGMTAKVKAAFVASNSGTPVVITSGFASQSIVRVLQGEKIGTLFHKDASLWEPSKDVSAREMAVAARECSRRLQNLSSDERKKILLDIADALEQNEDLIRTENEADVSAAQDAGYQKSLVDRLTLKPEKIASLAKSIRTLANMEDPINQILKRTEVAEDLVLEKTSCPLGVLLIVFESRPDALVQIASLAVRSGNGLLLKGGKEAMRSNTVLHKVITGAIPDNVGQKLIGLVTSRDEIADLLKLDDVIDLVIPRGSNKLVSQIKASTKIPVLGHADGICHVYIDKSADMNMAKRIVMDAKTDYPAACNAMETLLVHKDLIKAPGLDDILLSLKTEGVAIYGGPVAHEVLCIPKADSFHHEYSSMACTIEFVDDVQSAINHIHRYGSAHTDCIITTDDKVAETFLRQVDSAAVFHNASTRFSDGARFGLGAEVGISTGRIHARGPVGVEGLLTTRWIMRGSGQVVNGDKNVAYTHKNLPLQ

SEQ ID NO: 670 - DNA, 21 bp, Artificial sequence
  primer
atgagtgacagccagacgctg

SEQ ID NO: 671 - DNA, 25 bp, Artificial sequence
  primer
ttaacgggtaatcatgtcatcacgg

SEQ ID NO: 672 - protein, 698 aa, Artificial sequence
  consensus sequence
  Variant (2)..(2): Xaa in position 2 is any amino acid
  Variant (4)..(4): Xaa in position 4 is any amino acid
  Variant (6)..(7): Xaa in position 6 to 7 is any amino acid
  Variant (8)..(36): Xaa in position 8 to 36 is any or no amino acid
  Variant (38)..(55): Xaa in position 38 to 55 is any amino acid
  Variant (56)..(59): Xaa in position 56 to 59 is any or no amino acid
  Variant (61)..(62): Xaa in position 61 to 62 is any amino acid
  Variant (63)..(64): Xaa in position 63 to 64 is any or no amino acid
  Variant (66)..(70): Xaa in position 66 to 70 is any amino acid
  Variant (71)..(73): Xaa in position 71 to 73 is any or no amino acid
  Variant (75)..(75): Xaa in position 75 is any amino acid
  Variant (79)..(81): Xaa in position 79 to 81 is any amino acid
  Variant (83)..(85): Xaa in position 83 to 85 is any amino acid
  Variant (87)..(97): Xaa in position 87 to 97 is any amino acid
  Variant (98)..(99): Xaa in position 98 to 99 is any or no amino acid
  Variant (101)..(102): Xaa in position 101 to 102 is any amino acid
  Variant (103)..(111): Xaa in position 103 to 111 is any or no amino acid
  Variant (114)..(114): Xaa in position 114 is any amino acid
  Variant (117)..(118): Xaa in position 117 to 118 is any amino acid
  Variant (120)..(132): Xaa in position 120 to 132 is any amino acid
  Variant (133)..(135): Xaa in position 133 to 135 is any or no amino acid
  Variant (137)..(137): Xaa in position 137 is any amino acid
  Variant (141)..(142): Xaa in position 141 to 142 is any amino acid
  Variant (144)..(146): Xaa in position 144 to 146 is any amino acid
  Variant (148)..(148): Xaa in position 148 is any amino acid
  Variant (150)..(151): Xaa in position 150 to 151 is any amino acid
  Variant (154)..(155): Xaa in position 154 to 155 is any amino acid
  Variant (157)..(159): Xaa in position 157 to 159 is any amino acid
  Variant (161)..(166): Xaa in position 161 to 166 is any amino acid
  Variant (168)..(169): Xaa in position 168 to 169 is any amino acid
  Variant (174)..(174): Xaa in position 174 is any amino acid
  Variant (176)..(178): Xaa in position 176 to 178 is any amino acid
  Variant (180)..(182): Xaa in position 180 to 182 is any amino acid
  Variant (183)..(189): Xaa in position 183 to 189 is any or no amino acid
  Variant (194)..(194): Xaa in position 194 is any amino acid
  Variant (196)..(196): Xaa in position 196 is any amino acid
  Variant (198)..(198): Xaa in position 198 is any amino acid
  Variant (201)..(204): Xaa in position 201 to 204 is any amino acid
  Variant (207)..(207): Xaa in position 207 is any amino acid
  Variant (209)..(210): Xaa in position 209 to 210 is any amino acid
  Variant (212)..(212): Xaa in position 212 is any amino acid
  Variant (214)..(215): Xaa in position 214 to 215 is any amino acid
  Variant (218)..(221): Xaa in position 218 to 221 is any amino acid
  Variant (223)..(226): Xaa in position 223 to 226 is any amino acid
  Variant (227)..(227): Xaa in position 227 is any or no amino acid
  Variant (229)..(250): Xaa in position 229 to 250 is any amino acid
  Variant (251)..(254): Xaa in position 251 to 254 is any or no amino acid
  Variant (256)..(256): Xaa in position 256 is any amino acid
  Variant (260)..(260): Xaa in position 260 is any amino acid
  Variant (263)..(264): Xaa in position 263 to 264 is any amino acid
  Variant (267)..(268): Xaa in position 267 to 268 is any amino acid
  Variant (270)..(272): Xaa in position 270 to 272 is any amino acid
  Variant (274)..(277): Xaa in position 274 to 277 is any amino acid
  Variant (279)..(280): Xaa in position 279 to 280 is any amino acid
  Variant (282)..(293): Xaa in position 282 to 293 is any amino acid
  Variant (294)..(330): Xaa in position 294 to 330 is any or no amino acid
  Variant (333)..(342): Xaa in position 333 to 342 is any amino acid
  Variant (343)..(464): Xaa in position 343 to 464 is any or no amino acid
  Variant (467)..(467): Xaa in position 467 is any amino acid
  Variant (469)..(475): Xaa in position 469 to 475 is any amino acid
  Variant (476)..(476): Xaa in position 476 is any or no amino acid
  Variant (478)..(481): Xaa in position 478 to 481 is any amino acid
  Variant (483)..(483): Xaa in position 483 is any amino acid
  Variant (486)..(487): Xaa in position 486 to 487 is any amino acid
  Variant (489)..(493): Xaa in position 489 to 493 is any amino acid
  Variant (494)..(494): Xaa in position 494 is any or no amino acid
  Variant (496)..(496): Xaa in position 496 is any amino acid
  Variant (497)..(540): Xaa in position 497 to 540 is any or no amino acid
  Variant (543)..(544): Xaa in position 543 to 544 is any amino acid
  Variant (546)..(550): Xaa in position 546 to 550 is any amino acid
  Variant (552)..(552): Xaa in position 552 is any amino acid
  Variant (554)..(555): Xaa in position 554 to 555 is any amino acid
  Variant (557)..(569): Xaa in position 557 to 569 is any amino acid
  Variant (570)..(581): Xaa in position 570 to 581 is any or no amino acid
  Variant (583)..(583): Xaa in position 583 is any amino acid
  Variant (585)..(587): Xaa in position 585 to 587 is any amino acid
  Variant (589)..(595): Xaa in position 589 to 595 is any amino acid
  Variant (596)..(670): Xaa in position 596 to 670 is any or no amino acid
  Variant (672)..(673): Xaa in position 672 to 673 is any amino acid
  Variant (674)..(675): Xaa in position 674 to 675 is any or no amino acid
  Variant (677)..(678): Xaa in position 677 to 678 is any amino acid
  Variant (680)..(680): Xaa in position 680 is any amino acid
  Variant (681)..(682): Xaa in position 681 to 682 is any or no amino acid
  Variant (685)..(687): Xaa in position 685 to 687 is any amino acid
  Variant (688)..(695): Xaa in position 688 to 695 is any or no amino acid
VXKXGXXXXXXXXXXXXXXXXXXXXXXXXXXXXXXXLXXXXXXXXXXXXXXXXXXXXXXLXXXXGXXXXXXXXVXSGAXXXGXXXLXXXXXXXXXXXXXQXXXXXXXXXXXAAXGQXXLXXXXXXXXXXXXXXXXQXLLTXXDXXXRXRXXNAXXTXXXLXXXXXXPXXNENDXVXXXEXXXXXXXXXXGDNDXLXAXVAXXXXADXLXXLXDXXGLXXXXPXXXXXAXXXXXXXXXXXXXXXXXXXXXXXXXXGXGGMXTKXXAAXXAXXXGXXXXIXXGXXXXXXXXXXXXXXXXXXXXXXXXXXXXXXXXXXXXXXXXXXXXXXXXXGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRKXWXXXXXXXXGXXXXDXGAXXAXXXXXXSXXXXXXXXXXXXXXXXXXXXXXXXXXXXXXXXXXXXXXXXXXXXXLLXXGXXXXXGXFXXGXXXXXXXXXXXXXXXXXXXXXXXXXAXGXXXYXXXXXXXXXXXXXXXXXXXXXXXXXXXXXXXXXXXXXXXXXXXXXXXXXXXXXXXXXXXXXXXXXXXXXXXXXXXXXXXXXXIXXXXSXXIXXXLGXXXXXXXXXXXHRD

SEQ ID NO: 673 - protein, 21 aa, Artificial sequence
  protein pattern
  Variant (2)..(3): Xaa in position 2 to 3 is Ile or Val
  Variant (8)..(8): Xaa in position 8 is Ala, Ser or Thr
  Variant (10)..(11): Xaa in position 10 to 11 is any amino acid
  Variant (12)..(12): Xaa in position 12 is any or no amino acid
  Variant (14)..(16): Xaa in position 14 to 16 is any amino acid
  Variant (17)..(17): Xaa in position 17 is any or no amino acid
PXXNENDXVXXXEXXXXGDND

SEQ ID NO: 674 - protein, 28 aa, Artificial sequence
  protein pattern
  Variant (2)..(2): Xaa in position 2 is Ala, Gly or Ser
  Variant (3)..(3): Xaa in position 3 is Ala or Gly
  Variant (4)..(5): Xaa in position 4 to 5 is any amino acid
  Variant (6)..(6): Xaa in position 6 is Ala, Gly, Ser or Thr
  Variant (7)..(10): Xaa in position 7 to 10 is any amino acid
  Variant (12)..(13): Xaa in position 12 to 13 is any amino acid
  Variant (15)..(15): Xaa in position 15 is any amino acid
  Variant (16)..(16): Xaa in position 16 is Ile, Leu, Met or Val
  Variant (18)..(18): Xaa in position 18 is Ser or Thr
  Variant (20)..(22): Xaa in position 20 to 22 is any amino acid
  Variant (23)..(23): Xaa in position 23 is Phe, Leu or Met
  Variant (24)..(24): Xaa in position 24 is any amino acid
  Variant (25)..(25): Xaa in position 25 is Asp, Glu, Ser or Thr
  Variant (26)..(27): Xaa in position 26 to 27 is any amino acid
LXXXXXXXXXAXXLXXLXDXXXXXXXXP

SEQ ID NO: 675 - protein, 15 aa, Artificial sequence
  protein pattern
  Variant (2)..(2): Xaa in position 2 is any amino acid
  Variant (6)..(6): Xaa in position 6 is any amino acid
  Variant (7)..(7): Xaa in position 7 is Ala, Ser or Thr
  Variant (9)..(9): Xaa in position 9 is Ile, Leu or Val
  Variant (10)..(10): Xaa in position 10 is any amino acid
  Variant (13)..(14): Xaa in position 13 to 14 is any amino acid
  Variant (15)..(15): Xaa in position 15 is Ala or Thr
GXGGMXXKXXAAXXX

SEQ ID NO: 676 - protein, 20 aa, Artificial sequence
  protein pattern
  Variant (2)..(2): Xaa in position 2 is any amino acid
  Variant (3)..(3): Xaa in position 3 is any or no amino acid
  Variant (6)..(6): Xaa in position 6 is any amino acid
  Variant (7)..(7): Xaa in position 7 is any or no amino acid
  Variant (10)..(11): Xaa in position 10 to 11 is any amino acid
  Variant (13)..(15): Xaa in position 13 to 15 is any amino acid
  Variant (16)..(16): Xaa in position 16 is Trp or Tyr
  Variant (17)..(17): Xaa in position 17 is Ala, Asp, Glu, Gln or Ser
  Variant (18)..(19): Xaa in position 18 to 19 is any amino acid
  Variant (20)..(20): Xaa in position 20 is Phe or Leu
QXXAAXXGQXXLXXXXXXXX

SEQ ID NO: 677 - protein, 20 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any amino acid
  Variant (7)..(7): Xaa in position 7 is any or no amino acid
  Variant (9)..(9): Xaa in position 9 is Ser or Thr
  Variant (12)..(12): Xaa in position 12 is Ala or Ser
  Variant (13)..(13): Xaa in position 13 is Ile or Val
  Variant (14)..(14): Xaa in position 14 is Ala or Gly
  Variant (15)..(15): Xaa in position 15 is any amino acid
  Variant (17)..(19): Xaa in position 17 to 19 is any amino acid
  Variant (20)..(20): Xaa in position 20 is Ile, Leu, Met or Val
GXXXVXXVXSGXXXXGXXXX

SEQ ID NO: 678 - protein, 19 aa, Artificial sequence
  protein pattern
  Variant (3)..(3): Xaa in position 3 is Ala or Pro
  Variant (4)..(4): Xaa in position 4 is any amino acid
  Variant (6)..(6): Xaa in position 6 is Ile or Val
  Variant (7)..(8): Xaa in position 7 to 8 is any amino acid
  Variant (9)..(9): Xaa in position 9 is Ala, Ile or Val
  Variant (10)..(10): Xaa in position 10 is any amino acid
  Variant (12)..(12): Xaa in position 12 is any amino acid
  Variant (14)..(18): Xaa in position 14 to 18 is any amino acid
  Variant (19)..(19): Xaa in position 19 is Ala, Ile, Leu or Val
LLXXGXXXXXGXFXXXXXX

SEQ ID NO: 679 - DNA, 1818 bp, Escherichia coli
  CDS (1)..(1818)
atgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtaccggatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcataatcgtggcacgggtggtgcttgtcacaaccccgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgccgggatcaccgaagcggcgaaagaaacccagccggaagcgtatattgtcggcgaacattttggcgatgcacggcaatggttacaggccgatgtggaagatgccgccatgaactatcgtggcttcacattcccgttgtggggatttcttgccaataccgatatctcttacgatccgcagcaaattgatgcccaaacctgtatggcctggatggataattaccgcgcagggctttctcatcaacaacaattacgtatgtttaatcagctcgacagccacgatactgcgcgatttaaaacgctgctcggtcgggatattgcgcgcctgccgctggcggtggtctggctgttcacctggcctggtgtaccgtgcatttattacggtgatgaagtaggactggatggcaaaaacgatccgttttgccgtaaaccgttcccctggcaggtggaaaagcaggatacggcgttattcgcgctgtaccagcgaatgattgcgctgcgtaagaaaagtcaggcgctacgtcatggcggctgtcaggtgctgtatgcggaagataacgtggtggtatttgtccgcgtgctgaatcagcaacgtgtactggtggcaatcaaccgtggcgaggcctgtgaagtggtgctacccgcgtcaccgtttctcaatgccgtgcaatggcaatgcaaagaagggcatgggcaactgactgacgggattctggctttgcctgccatttcggctacggtatggatgaactaa

SEQ ID NO: 680 - protein, 605 aa, Escherichia coli
MMLNAWHLPVPPFVKQSKDQLLITLWLTGEDPPQRIMLRTEHDNEEMSVPMHKQRSQPQPGVTAWRAAIDLSSGQPRRRYSFKLLWHDRQRWFTPQGFSRMPPARLEQFAVDVPDIGPQWAADQIFYQIFPDRFARSLPREAEQDHVYYHHAAGQEIILRDWDEPVTAQAGGSTFYGGDLDGISEKLPYLKKLGVTALYLNPVFKAPSVHKYDTEDYRHVDPQFGGDGALLRLRHNTQQLGMRLVLDGVFNHSGDSHAWFDRHNRGTGGACHNPESPWRDWYSFSDDGTALDWLGYASLPKLDYQSESLVNEIYRGEDSIVRHWLKAPWNMDGWRLDVVHMLGEAGGARNNMQHVAGITEAAKETQPEAYIVGEHFGDARQWLQADVEDAAMNYRGFTFPLWGFLANTDISYDPQQIDAQTCMAWMDNYRAGLSHQQQLRMFNQLDSHDTARFKTLLGRDIARLPLAVVWLFTWPGVPCIYYGDEVGLDGKNDPFCRKPFPWQVEKQDTALFALYQRMIALRKKSQALRHGGCQVLYAEDNVVVFVRVLNQQRVLVAINRGEACEVVLPASPFLNAVQWQCKEGHGQLTDGILALPAISATVWMN

SEQ ID NO: 681 - DNA, 1422 bp, Thermotoga maritima MSB8
  CDS (1)..(1422): transl_table=11
atgatgtacccgatgccgtcttgggtttacgacagtgtcgtgtatcagatctttccagatagatttttcatcggaaagggaaaaacggtggaagacaaaaaggatctgtacctgaagcggggaggagtcatagagaaatggggagttcctccccgcaaacttcccggtgctcagcacgtgaagatcttctacggaggagatctgtggggaatagccgagaaggtcgattattttgaagaacttggaatcaacgttctgtacctcactcctatctttttgtccgataccaatcacaagtacgacacgatcgattacttcagggtggatccacagttcggcggaaagagggcttttctgcaccttttgagggttctccatgagaggagtatgaaactcattctcgatggtgtgttcaaccacgttgggagtcagcatccgtggttcaaaaaagcgaagaaaaacgatccagagtacgtgaacagatttttcctttacaaagataggcacagatcgtggttcgacgttggaagccttcccgagctgaacgtggaagtcgaagaagtgaaggaatacattttgaaagttgtcgagcactacctgaaactggggatagacggttggaggctggattgtggccacgatcttggacctaccgtcaacctgtggatcaacatgaaagtgaaagagttctcagcggaaaagtacctcgtgagtgagatatggacttacccggcaggatgggatatggttgatggtctgatgaattacaacttcagaaaccttgtgcttagttatgtgaacggcgagacggattccataggttttcacctggaaagagcttacagggagacgaagaacatattcggttgctggaacatgcttgacagtcacgacaccccgagactcgccacaatggttcccgacagagacctgagaaaactcgctgtagttcttcagttcacttatcccggtgttccgctcgtttactatggaacagagataggtctcacaggtggagaagatccagagtgtcgtgccaccatggaatggaacagagagaaatgggatgttgatctgttcgagttctacaagaagatgatcagactgagaaggacggatccaggtttgcgctttggagagtttgtcttgctgaacgactcacctctcgcgtttctcagaaaggctcctcatcctcttcaaaacaccatcgtggtggtgaacccaggagaagagaaggtgctggttctctccattcccgacgggaaaattatgaacaccactccccttgtcgatgtgttcagcggagaaagattccacgttgacggcggggttgtgaagcttccccttctagcgagatctttcagaattctcaagcccgaggatctgagagtgggtaagtacagattgtacaagagagtttga

SEQ ID NO: 682 - protein, 473 aa, Thermotoga maritima MSB8
MMYPMPSWVYDSVVYQIFPDRFFIGKGKTVEDKKDLYLKRGGVIEKWGVPPRKLPGAQHVKIFYGGDLWGIAEKVDYFEELGINVLYLTPIFLSDTNHKYDTIDYFRVDPQFGGKRAFLHLLRVLHERSMKLILDGVFNHVGSQHPWFKKAKKNDPEYVNRFFLYKDRHRSWFDVGSLPELNVEVEEVKEYILKVVEHYLKLGIDGWRLDCGHDLGPTVNLWINMKVKEFSAEKYLVSEIWTYPAGWDMVDGLMNYNFRNLVLSYVNGETDSIGFHLERAYRETKNIFGCWNMLDSHDTPRLATMVPDRDLRKLAVVLQFTYPGVPLVYYGTEIGLTGGEDPECRATMEWNREKWDVDLFEFYKKMIRLRRTDPGLRFGEFVLLNDSPLAFLRKAPHPLQNTIVVVNPGEEKVLVLSIPDGKIMNTTPLVDVFSGERFHVDGGVVKLPLLARSFRILKPEDLRVGKYRLYKRV

SEQ ID NO: 683 - DNA, 1737 bp, Bacillus halodurans C-125
  CDS (1)..(1737): transl_table=11
ttgaaagctacaatctaccatcgaccaaaaagtgaagacgcttatgcttatgataaaagcacgatgcacattcgtcttcgcacaggtaagaatcacgtgcgaaaagtgaacctgatttatggtgatccttatgactggacgaaaaaccaatgggtaacttctaaaaaagagatgactccaacaggatctgatgcacagcatgatttctggttcgtagaggtgactcctccttatcgacggttgcgttatggtttcgaaattataacaaaaactgaaacgatctactatggagaaagtgggtttctcgatacaccatcaaaagatacgagcgactatttctgctttccatttatgaatccagctgatttgttttcaccacctgagtgggtaaaagacaccgtatggtatcaaatttttcccgaacgctttgcaaatggggatccgagccgtaatcctgaaggtaccttaccgtggggaagcgctgccccaactccaaccaaccatttcggtggagaccttcaagggatcatcgaccatctcgattacttgcaagagttagggattaatggaatctatttaacaccgatctttgaagcgtcttctaatcataaatacgacacgattgattatttaaaagtggaccctcactttggtgataaaacaacatttaaacgtcttgtagatgagtgccacaaacggggaattcgcatcatgcttgatgccgttttcaatcatgcaggcttctactttccaccgtttcaagatgtgctcaaaaaccagcaacactcaaaatatagtgattggtttcatttgcgtgactttcctgttcgtgctgaagagccgcccaactacgatacgtttgccttcacgccatttatgccaaagttcaatacggaaaacgaggaagtgagggaatacttactgaatgtggcaacgtattggatcaaagagtttgacattgacggctggcggttagacgtagctaatgaagtcgatcatgccttctggcgagaatttcgtaaaagagttaaagcattaaagcctgacttatacatccttggtgaagtatggcacaactcccttccttggcttgccggcgatcaatttgatgcggtcatgaattatccactgactaatgcgatcatcgattttgccggaaaacaaaagataggtcaacagcgattcgagcatgtcataacccaattgacgcacatgtacccaattcacgtccaacaagtagcctttaatttgctcggtagtcatgataccccgcgaatattgacgcaaacggacaatgatgtggcacgtgttaaacttcagtttctcttgctcttttcgcagcgcggaacaccgtgtatttattacggtgatgagattggcatgacgggtgggcaagatcctggatgtcgtaaatgcatggtttgggaagaagaagaacaaaatcaagagttactctcctttgtcaaaaggctcattcaacttcgcaagcaagagaaagctttcggaaccgaaggggatttgacgtttgtggagaatgattcttctcttctcatctatcaaaagacatacgaaaatcaacagctcttgtttgtcatcaattcaacagatcaaccagacagtgttcagttacctgttagctggacaaatcgtaacgcaaatgacttgctaacaggtgaaactttctcgctcgcaacagaaattgtcatcccggctaaatccgcgatggttcttaaatag

SEQ ID NO: 684 - protein, 578 aa, Bacillus halodurans C-125
MKATIYHRPKSEDAYAYDKSTMHIRLRTGKNHVRKVNLIYGDPYDWTKNQWVTSKKEMTPTGSDAQHDFWFVEVTPPYRRLRYGFEIITKTETIYYGESGFLDTPSKDTSDYFCFPFMNPADLFSPPEWVKDTVWYQIFPERFANGDPSRNPEGTLPWGSAAPTPTNHFGGDLQGIIDHLDYLQELGINGIYLTPIFEASSNHKYDTIDYLKVDPHFGDKTTFKRLVDECHKRGIRIMLDAVFNHAGFYFPPFQDVLKNQQHSKYSDWFHLRDFPVRAEEPPNYDTFAFTPFMPKFNTENEEVREYLLNVATYWIKEFDIDGWRLDVANEVDHAFWREFRKRVKALKPDLYILGEVWHNSLPWLAGDQFDAVMNYPLTNAIIDFAGKQKIGQQRFEHVITQLTHMYPIHVQQVAFNLLGSHDTPRILTQTDNDVARVKLQFLLLFSQRGTPCIYYGDEIGMTGGQDPGCRKCMVWEEEEQNQELLSFVKRLIQLRKQEKAFGTEGDLTFVENDSSLLIYQKTYENQQLLFVINSTDQPDSVQLPVSWTNRNANDLLTGETFSLATEIVIPAKSAMVLK

SEQ ID NO: 685 - DNA, 1704 bp, Streptococcus pyogenes M1 GAS
  CDS (1)..(1704): transl_table=11
atgaatgttgccggaatgctccatattcctgattcgaggtattgctttgccatatctcaaaaggaacttgtcatccgattacgcgtggccaaagaagatagaggtattactgttaatttggtccacgggcctaaatatggttatcatgaattccaagaagaattggaaatgtcagttgcctatacagaccatacgcatgcttattatgaaactactttaacattagacgatgtgaggttggcctacatttttaaaattgaagaagaaggtcaaacctattattttagtgaagatgggttaactactagttacgatttttcaaatgggttttataatttcttccaaatgccttatatcaatgctgttgatgttcatcaagtcattccttggacaaaagacgcggttttttatcaaatctttgttgatcgctttaaccgtggggattgggaaaaaggtgacagttatgtcaacatgggttggttagaaaaaccgactcctaaaagttttgctggtggagatttaaagggaattacagaaaaattagattacctcaaagatttagggattactgtcatctatttaacgccaatttttcaatccattagtaatcacaaatatgatattagtgattactacgctattgatccacaatttggaactaaatatgatttgcaagaattgattgatttagctcacaaaatgggaatcaagattattctagacgctgtctttaaccatgccagcagtgatgccgtggaatttcaggatgtcttgagatacggtaaagagtctaagttttttgattggtttatgactcatgatgaacacccatccatggacctagtaaactatgaaacctttgctggatgtaactatatgcccaaatggaatacctcaaatagagacgtgcaagactatctgattgagattgggcgatactggattaaagaattttgtatcgatggttggcgcctagatgtttctgatgaagtatctcatgatttttggcgacgtttccgtcaggcggttaaagcggaaaaagcagatgccattttaattggggagaactggcatgatgcctatccttatttggcaggggatcagtatgatgggataatgaattatgctttcaccaaagcctgtttggattactttgcttttgaaaccatgacatcaaaacaattggctgagaaattaagcaacattttgatgcgaaacacttggcaagtcaatcgcatgaacttgaatcttttggattctcatgatacgcatcgtttcttcactcaagttaagggttccaaagataaattgttagctgctttagcattgctctttatctttatgggcattccttgcttgtattatgggacagaagtggcaatggaagggggttacgaccctgattcgcgtcgcggttttccttgggatgatgctgagcgggacaaggatttctttagcaaagtaaaagcgattattgctcttcgccaacagccagctcttcaagaaggagctattagcattgattatgacgaagactgcctcattctgaaacgcagcttaggtgagcaaagcatttcacttgttcttaacaatggtgagagtgcttattctattaaggaaggaggacagattttgacaagcaatggggtaactaaaaacaaaaaacaattactccaggatggatatattgtgtttagtaactaa

SEQ ID NO: 686 - protein, 567 aa, Streptococcus pyogenes M1 GAS
MNVAGMLHIPDSRYCFAISQKELVIRLRVAKEDRGITVNLVHGPKYGYHEFQEELEMSVAYTDHTHAYYETTLTLDDVRLAYIFKIEEEGQTYYFSEDGLTTSYDFSNGFYNFFQMPYINAVDVHQVIPWTKDAVFYQIFVDRFNRGDWEKGDSYVNMGWLEKPTPKSFAGGDLKGITEKLDYLKDLGITVIYLTPIFQSISNHKYDISDYYAIDPQFGTKYDLQELIDLAHKMGIKIILDAVFNHASSDAVEFQDVLRYGKESKFFDWFMTHDEHPSMDLVNYETFAGCNYMPKWNTSNRDVQDYLIEIGRYWIKEFCIDGWRLDVSDEVSHDFWRRFRQAVKAEKADAILIGENWHDAYPYLAGDQYDGIMNYAFTKACLDYFAFETMTSKQLAEKLSNILMRNTWQVNRMNLNLLDSHDTHRFFTQVKGSKDKLLAALALLFIFMGIPCLYYGTEVAMEGGYDPDSRRGFPWDDAERDKDFFSKVKAIIALRQQPALQEGAISIDYDEDCLILKRSLGEQSISLVLNNGESAYSIKEGGQILTSNGVTKNKKQLLQDGYIVFSN

SEQ ID NO: 687 - DNA, 1974 bp, Deinococcus radiodurans R1
  CDS (1)..(1974): transl_table=11
ttgaccgcgctgcccttttcccccacactggcttgcaaatccaaaggcaacgcttgccccctccggcacgacctcccagcgcgactttgcgcggcaggccgtgccggagcttcgttttgccccctcatccaaggagttcttatgtaccccaccgccaccctgagtgcccagcacgaccacacccccggttacaccgaacgcctcggtgcgctcctcggcgggcacgtccgcgtgcggctgcggaccaccctgccggtcctgggcgtgcggctcaaagtcgtgcagatcggtgaaatcgagactcttcccgcccgcgaggtgacgggcttgcagggcgaaggccgctggttcgaggccgacctgccgctgcacgaggcccgcgtgcgctacgcctggcacctcgacctgcctggcgaccacctcaacctgacccggctggggctgcaccacgcgcgccggggctttcgctcgtggtttcagtacctcgcgggctatcaggcgcccgagtgggcctggaagtcggtcttttatcagattttccccgaccgctttcgcaacggtgattccacgaacgacgtgcagaccggcgaatacttgtacgaaggccgcccggtggaaaaggtggagtggacgcacccggttgacgcctggggcgatattcacgggcactacggcggcgacctcgcgggcatcacgcaggcggtgccgtatttgcaggcgctcggcgtgaccgggctgtggctcacgccgattttcacctcgccgagcaaccaccgctacgacatcaccgattaccgcgccattgacccccacctcggcggggacgccgcgtgggacgcgctggtgcaggcgacggacgcggcgggcatccgcatcgtccttgacggggtgttcaaccatatgggcaacgaaaacgcgctgtttcaggccgcgctcgctgccgaggacgcccccgagcgggccatgttcacctggcgcgatacgccgggcaagccgccctaccactcctttttcgacgtggcgacgctgcccaaaatcgactacgccaacgagcgggcggtggaggagtttttcagcggcgagcgcagtgtggtccggcactggctgcggcgcggcgcggcgggctggcggctggacgtggcgcacatgctcggcaagggcggcaccgaggaagacaatctggcgctgcaccgcgtgctcaaggcggcggcgcggcaggaaaaggccgacgcctacgtgttcggcgagcgcttctacgaccccgaactcgcgctcgacgggcagggcgaagacggcgcgatgaactaccacggttttggcctcccggtgatgcagtggctggcgggcgcgacctatttcaacgaaccgagccgcctggacggcactgaactcgccgaaattctctgggatgcgtaccacgcgctgccaccgcaggccgcgctgaacatgttcaacctgctcgaatcgcacgacatcgggcgggcgctgtggcggctggggggcgaccgcaccaagtaccgcgccgcactcacgctgctgctcgcctacgcgggcgtgccgtgcctgtactacgggagcgaaatcggcctctcgcagtcgcgcgacggcaacatgccgtggtgccgcgagccgatgccctgggacgaggcgaggtgggacatggagctgctcgcccatgtcaaagctctggtgaaggttcgccgcgagacgcccgtgttgcacaccggggcccttcagttcatccacgccgagccggacgccctcgccttcctgcgcgaagtgaccgggccggacggcgcggcggagcgggtggtcgccctcgccagccgccgggccggggcacatccggtgaccttcaccctcccggcgggcgagtggcaagacgccctgagcggcgagcggctcggcgggggagaggtcacgctggacgcggcgggcgggcagttgctgctcagtttgcctctcagtcgctga

SEQ ID NO: 688 - protein, 657 aa, Deinococcus radiodurans R1
MTALPFSPTLACKSKGNACPLRHDLPARLCAAGRAGASFCPLIQGVLMYPTATLSAQHDHTPGYTERLGALLGGHVRVRLRTTLPVLGVRLKVVQIGEIETLPAREVTGLQGEGRWFEADLPLHEARVRYAWHLDLPGDHLNLTRLGLHHARRGFRSWFQYLAGYQAPEWAWKSVFYQIFPDRFRNGDSTNDVQTGEYLYEGRPVEKVEWTHPVDAWGDIHGHYGGDLAGITQAVPYLQALGVTGLWLTPIFTSPSNHRYDITDYRAIDPHLGGDAAWDALVQATDAAGIRIVLDGVFNHMGNENALFQAALAAEDAPERAMFTWRDTPGKPPYHSFFDVATLPKIDYANERAVEEFFSGERSVVRHWLRRGAAGWRLDVAHMLGKGGTEEDNLALHRVLKAAARQEKADAYVFGERFYDPELALDGQGEDGAMNYHGFGLPVMQWLAGATYFNEPSRLDGTELAEILWDAYHALPPQAALNMFNLLESHDIGRALWRLGGDRTKYRAALTLLLAYAGVPCLYYGSEIGLSQSRDGNMPWCREPMPWDEARWDMELLAHVKALVKVRRETPVLHTGALQFIHAEPDALAFLREVTGPDGAAERVVALASRRAGAHPVTFTLPAGEWQDALSGERLGGGEVTLDAAGGQLLLSLPLSR

SEQ ID NO: 689 - DNA, 1497 bp, Deinococcus radiodurans R1
  CDS (1)..(1497): transl_table=11
gtgagccgcccacccgctatcctgcgccccgccatgtccgagcccgtctctgccgttcccctgtctgctcccgtcacccccgagtgggtcgccgacgccgtcttctaccagattttccccgaccgcttcgcccgctcgggccgcgtgaccggcctgcaccttcagccctggggcagcgcgccgaccattcacggctacatgggcggcgacctgtggggcgtggccgagcggctgggcgaccttgccggcctcggcgtgaatgcgctgtatttctgcccggtgtttcagtcggcctccaaccaccgctaccacacccacgactattttcaggtggaccccatgctcggcggcaacgcggcgctgcggcacctgctcgatgaggcgcacgcgcgcggcatccgggtggtgctcgacggggtgttcaaccatgccagccggggcttttttcagttcaacgacctgctcgaacacggtgaggcgagtgcgtaccgcgactggtttcatgtgaccggctggccgctgagcgcctacgacgaggaccgccccgccaactacgcggcgtggtggggcatccgggcgctgcccaagttcaacaccgaccaccccgaggtgcgcgagtttctgctgagcgtggccgaatactggatgcacttcggcatcgacggctggcggctcgacgtgccgaacgagattgacgacgacgccttctggcaggagtttcgccgccgggtcaaggcgattaaccccgacgcctacatcgtgggcgaaatctggggcgacgccggacgctggctggcgggcgaccagttcgacgcggtgatgaactaccacttcacccgcccctgcctgggctttttcggggcgcggacgctcgaccatccgatgaacgaacgcagcggcaccgggcgggtggagccgctggacgccgccgcttttgccgtgcgggtggaagaagtcacccgcatgtaccaccccgccgtcgtgcgcgcgcagctcaatctgctcgactcgcacgacaccgcccgcttcctgacggcggtgggcggcgacgcctcggcgcagcggctcgcgctcgtgtttcagttcagctatgtgggcgcgccctgtctgtactacggcgacgaaatcgggctgcccggcggcgtggaccctgactgccgccgcgcttttccctgggacgagccgcagacctgggaccacgacaccctgaccctcgtgcgcgagttgacggcggcgcggcaccgttcggcggcactgcggcgcggcgactttacggtgctgcacgcgcagggcgagcaggtgtcgttcgctcgcaagcatgacggagaggcggcgtatgtggccttcaactgcgcgctggatgccgccccggttccggtgcccgccacatcgggccgttaccgcgacatgctgacgggcgcggtgcatgacctgaacgaaagctcggtgctgacgctgcctgcccggacggcggcgttgctgctgtgcgaggggtaa

SEQ ID NO: 690 - protein, 498 aa, Deinococcus radiodurans R1
MSRPPAILRPAMSEPVSAVPLSAPVTPEWVADAVFYQIFPDRFARSGRVTGLHLQPWGSAPTIHGYMGGDLWGVAERLGDLAGLGVNALYFCPVFQSASNHRYHTHDYFQVDPMLGGNAALRHLLDEAHARGIRVVLDGVFNHASRGFFQFNDLLEHGEASAYRDWFHVTGWPLSAYDEDRPANYAAWWGIRALPKFNTDHPEVREFLLSVAEYWMHFGIDGWRLDVPNEIDDDAFWQEFRRRVKAINPDAYIVGEIWGDAGRWLAGDQFDAVMNYHFTRPCLGFFGARTLDHPMNERSGTGRVEPLDAAAFAVRVEEVTRMYHPAVVRAQLNLLDSHDTARFLTAVGGDASAQRLALVFQFSYVGAPCLYYGDEIGLPGGVDPDCRRAFPWDEPQTWDHDTLTLVRELTAARHRSAALRRGDFTVLHAQGEQVSFARKHDGEAAYVAFNCALDAAPVPVPATSGRYRDMLTGAVHDLNESSVLTLPARTAALLLCEG

SEQ ID NO: 691 - DNA, 1764 bp, Streptococcus pneumoniae R6
  CDS (1)..(1764): transl_table=11
atgaatactttaggagacaaattgatggaattgagtgctatttaccatgggcctgagtcggagtatgcctatctttataaggataagaaactccatattcgaattcgaactaagaaaggggacattgaaagcatcaacttgcactatggggacccttttatctttatggaggagttttatcaggatacaaaagaaatggtcaagataacttctggtaccttatttgaccattggcaggttgaagtgtcagttgactttgcacgtatccagtatctctttgagctcagagatacagaaggtcaaaatattttgtatggcgataaagggtgtgtggaaaattctctagaaaatcttcatgcaattgggaatggatttaagttgccttatcttcatgagattgatgcctgcaaggttcctgactgggtttcaaatacggtatggtatcagatatttcctgaaagatttgccaatggcaatgctctattaaacccagaagggactttagactgggattcatctgtcacacctaagagcgatgatttctttggtggtgatttacaggggattattgatcatatggattacttgcaagacttgggtattactggactatatctttgtcccatctttgaatctacaagcaatcacaagtacaatacgacagattactttgaaattgaccgtcattttggagacaaggagacctttcgggaactggtggatcaagcgcatcatcgtggcatgaaagtcatgctggatgcggtatttaatcatattgcttcgcaatctcttcaatggaaaaatgtcgtcaaaaatggtgaacagtctgcttataaggattggttccatattcaacaattcccagtgacaactgaaaagctagttaataagagagacttaccctatcatgtttttggtttcgaggactatatgcctaagctaaatacagccaatccagaggtcaagaattatcttttaaaggttgcgacttattggattgaagagtttaatatcgatgcttggcgtttggatgtggctaatgagattgaccatcagttctggaaggattttcgtaaggcagttttagctaaaaatcctgatctttatatcctaggagaagtctggcatacatctcagccttggctaaatggagatgagttccatgccgtcatgaattatcctttatctgatagtatcaaggactatttcttacgaggaattaagaagacagaccagttcatcgatgaaatcaatggagagtctatgtattacaagcagcagatttcagaggtcatgtttaatctcttggattcacatgatacagagcgaatcctgtggacggccaatgaagatgttcaactggttaaatcagccttagcctttctctttttacaaaaaggaacaccgtgcatttattacgtaaccgagctagccttgactggaggaccagatccagattgtcgtcgttgtatgccttgggaacgtgtatcaagtgacaatgatatgctgaactttatgaagaggctgattaagattcggaaatacgcgtcagtaatcatttcgcatggcaagtatagccttcaagaaatcaactctgatctagtagctctggaatggaaatacgaaggacggatcctcaaagcaatattcaaccaatcaacagaagattatcttttagagaaagaagcagtagcactagcaagcaattgccaagaattggataatcagcttgtcatctctccagatggatttatgattttctaa

SEQ ID NO: 692 - protein, 587 aa, Streptococcus pneumoniae R6
MNTLGDKLMELSAIYHGPESEYAYLYKDKKLHIRIRTKKGDIESINLHYGDPFIFMEEFYQDTKEMVKITSGTLFDHWQVEVSVDFARIQYLFELRDTEGQNILYGDKGCVENSLENLHAIGNGFKLPYLHEIDACKVPDWVSNTVWYQIFPERFANGNALLNPEGTLDWDSSVTPKSDDFFGGDLQGIIDHMDYLQDLGITGLYLCPIFESTSNHKYNTTDYFEIDRHFGDKETFRELVDQAHHRGMKVMLDAVFNHIASQSLQWKNVVKNGEQSAYKDWFHIQQFPVTTEKLVNKRDLPYHVFGFEDYMPKLNTANPEVKNYLLKVATYWIEEFNIDAWRLDVANEIDHQFWKDFRKAVLAKNPDLYILGEVWHTSQPWLNGDEFHAVMNYPLSDSIKDYFLRGIKKTDQFIDEINGESMYYKQQISEVMFNLLDSHDTERILWTANEDVQLVKSALAFLFLQKGTPCIYYVTELALTGGPDPDCRRCMPWERVSSDNDMLNFMKRLIKIRKYASVIISHGKYSLQEINSDLVALEWKYEGRILKAIFNQSTEDYLLEKEAVALASNCQELDNQLVISPDGFMIF

SEQ ID NO: 693 - DNA, 1527 bp, Synechocystis sp. PCC 6803
  CDS (1)..(1527): transl_table=11
gtgccccaccattacgacagggtaaatattaacaaattattaacaaggactagaatcaccatggttacaaccccagattgggtgaaaaaagccgttttctatcaaatttttcctgaccgttttgccatcggccaacaacaggcgatcgccgtcgctcaacaaccaaagctagaaccatgggaggccccgccaacggtgcagggttataaggggggcaacctgtggggagtgatcgaacatttggattatctccaggattcgggcattaccgctttatacttgacccccattttccagtccgcctgtaatcaccgttatcacacccatgactattaccaagtggatcctctactggggggcaacgaggcgttgcaggctttactaacccaggcccaccgccgggagatgaaagtagtcttggatggagtgtttaaccatgccagcaggggtttctactttttcaacgacattttggaaaatggcccccattctccttggttagattggtttcacattgaagattggcccctatcagcctatgacggttctctgccagctaactatcggggctgggtagatttgcgggccctgccccagtttaaccatgaccatcccgacgtacgggaatatttgatgcgggtgggggagtattggattgcccagggcattgatggttggcgtttggatgtgcccgattgtgtcaaagcggaaggtttttggcaagaattccgctgcagggtcaaggccattaatccagaagcctacattgtgggggaaatttggtgtgatgctagcccctggttagccggagatcaattcgatggggtgatgaactatcgctttaccgaacctaccgtagcttttgccattggcgatcgcctgcaaaaagaacatctacggggggaagaatatcgtccttacccagccctaactgcagaagcctatggggaaagaattagccaactgctgcaacaacatccctgggaaattcagttaacccaattaaatttactcaacagccacgacaccgcccgcttattaaccctagccaatggcgatcggcccagcgttaacctcgctcttttactgatgtttactttccccggtgctccctgtgtttactacggagacgaagtgggtttgcctggggaggccgaccccgattgtcgccgagtttttcctgctaaaactgactgggacttggattgttgggaattctaccgccaattgattgccctgcgccatcgctatcaatgtttgcaattgggggattacaaaattatcgccacggcaggtatgggctatgtttttcaacggcaatacggcgatgaaaccctaatggttgccgttaatagtggtgacaacataatagaaattatattatctccagacataataaatttggataaaatagacatagctgaacctgtatttagcgctaatggtgagaccgtaattgaccggaacaccgcagggttacttttgaccatggcccctcaatcaggagcagctttcgccatcatttga

SEQ ID NO: 694 - protein, 508 aa, Synechocystis sp. PCC 6803
MPHHYDRVNINKLLTRTRITMVTTPDWVKKAVFYQIFPDRFAIGQQQAIAVAQQPKLEPWEAPPTVQGYKGGNLWGVIEHLDYLQDSGITALYLTPIFQSACNHRYHTHDYYQVDPLLGGNEALQALLTQAHRREMKVVLDGVFNHASRGFYFFNDILENGPHSPWLDWFHIEDWPLSAYDGSLPANYRGWVDLRALPQFNHDHPDVREYLMRVGEYWIAQGIDGWRLDVPDCVKAEGFWQEFRCRVKAINPEAYIVGEIWCDASPWLAGDQFDGVMNYRFTEPTVAFAIGDRLQKEHLRGEEYRPYPALTAEAYGERISQLLQQHPWEIQLTQLNLLNSHDTARLLTLANGDRPSVNLALLLMFTFPGAPCVYYGDEVGLPGEADPDCRRVFPAKTDWDLDCWEFYRQLIALRHRYQCLQLGDYKIIATAGMGYVFQRQYGDETLMVAVNSGDNIIEIILSPDIINLDKIDIAEPVFSANGETVIDRNTAGLLLTMAPQSGAAFAII

SEQ ID NO: 695 - DNA, 1818 bp, Salmonella typhimurium LT2
  CDS (1)..(1818): transl_table=11
atgttgaatgcctggcacttaccggttgccccatttgtgaagcaacataacgataaattaaccattacgctgtggctgagcggagaaaatccgccgtctcgcgtgacgttgcgctcagaattcgataatgaagaaatctcactggcgatgcgcaaacagcgccgccagccgcagccgggcgtgacggcgtggcgagcgacgctcaatatcgcgttagggcaaccccgtcgccgttacagctttaaattgctttggcatgaccgccagctttggtttacgccacagggatttagccgttttccgcctgcgcgtctggaacaatttgcggttgatgtgccggatagcggcccgcagtgggtcgccgatcaaattttttatcagatcttcccggatcgttttgcccgcagccagtctcgtgaagccgggcaggaccgggtgtactaccatcatgccgcaggtcaggagattgtgctgcgcgactgggacgatcctttaaccccccaggcgggcggttccaccttttacggcggctgtctgaatggcatttgtgagaagctgccgtatctgaaaaaactgggcgtcacagcgctatatctgaatccggtatttaccgcgccgagcgtccataagtacgatacggaagattatcgccatgtcgatccgcaatttggcggcgatcgggcgctgctacgcctgcggcgtaaaacccaggtgcagggcatgaggctggtgctggatggcgtgtttaatcatagcggcgactcgcatgtgtggtttgacaggcataaccgcagcactggcggcgcgtgccatcacccggactcgccgtggcgcgactggtactccttttcaccacaaggcgtggcgctggactggctgggttatccgagcctgccgaaactcgattatcaatcagaaacgctggtcgatgagatctatcgcggtgaggacagtatcgttcgtcactggctaaaggctccgtggaatatggacggctggcggctggatgtcgtacatatgctgggcgaggcgggcggggcgcgtcataatttgcagcacgtcgccggtattacccgggcggcaaaagaggcgcagcccgaagcctatattgtgggggaacatttcggcgatgcgcggcagtggctacaggccgatgcggaagatgccgccatgaattatcgcggcttcaccttcccgctatggggatttctcgccaatactgatatcgcttacgaaccacagcatattgatgcccggacctgtatcgcgtggatggataactaccgcgccgggctgtcacatcagcaacaactgcgcatgtttaatcaactcgacagccatgatactgcgcgctttaaaactctgctgggtaaagacgcggcgcgcctgccgctggcggtggtctggctgtttacctggcccggcgtgccatgtatttattacggcgatgaagtcggcgtggacggcgcaaatgaccccatgtgccgcaaaccgttcccatgggatgaacgcaagcaggacggcaacttgctggcgctgtaccagcgtatggcgaaactgcgccagagcagtctggcgctgcgtcgtggcggatgccaggcgctgtatgccgaaggtgacgtagtggtattcgtgcgagtttatcagcagcagcgggcgctggtggcgattaaccggggcgaggcctgtgaagtggcgctggaagcgttgccgttgctgaacgtggccggatggcaatgtaaaacgggaagcggtgatatccgcgagggaagacttagtttacccgcgatttccgcgacggtatggatgaatcgttga

SEQ ID NO: 696 - protein, 605 aa, Salmonella typhimurium LT2
MLNAWHLPVAPFVKQHNDKLTITLWLSGENPPSRVTLRSEFDNEEISLAMRKQRRQPQPGVTAWRATLNIALGQPRRRYSFKLLWHDRQLWFTPQGFSRFPPARLEQFAVDVPDSGPQWVADQIFYQIFPDRFARSQSREAGQDRVYYHHAAGQEIVLRDWDDPLTPQAGGSTFYGGCLNGICEKLPYLKKLGVTALYLNPVFTAPSVHKYDTEDYRHVDPQFGGDRALLRLRRKTQVQGMRLVLDGVFNHSGDSHVWFDRHNRSTGGACHHPDSPWRDWYSFSPQGVALDWLGYPSLPKLDYQSETLVDEIYRGEDSIVRHWLKAPWNMDGWRLDVVHMLGEAGGARHNLQHVAGITRAAKEAQPEAYIVGEHFGDARQWLQADAEDAAMNYRGFTFPLWGFLANTDIAYEPQHIDARTCIAWMDNYRAGLSHQQQLRMFNQLDSHDTARFKTLLGKDAARLPLAVVWLFTWPGVPCIYYGDEVGVDGANDPMCRKPFPWDERKQDGNLLALYQRMAKLRQSSLALRRGGCQALYAEGDVVVFVRVYQQQRALVAINRGEACEVALEALPLLNVAGWQCKTGSGDIREGRLSLPAISATVWMNR

SEQ ID NO: 697 - DNA, 1776 bp, Listeria monocytogenes EGD-e
  CDS (1)..(1776): transl_table=11
atggaaaaagcagggatttaccatcaaccggcgagtagctatgcatatagttatgacgctaaaacactacatattcggattagaactaaacgcttggatattagcaaggttactctaattgctgccgacccttacttatggaaagatggaaaatggcaaagtgaatcgtatacaatgcgcaaaatcgcagaaacagaagagcatgattattggttttttgcaattacaccagaacatagacgccttcaatatggatttttattaaccgatactgaaggagaaacaacattttatggcggacgtggtttttttgagccgaccgaggcgaatttagctacgatggattattactttaaatttccgtttatccatgcagtagatacatttgaggcacctgaatgggttagaaataccatttggtaccaaattttcccagaacgttttgcgaatggtaatccagctatttctccggaaaataccttgccgtgggggagtaaagatccgaatacaacagacttttttggtggagatattgaagggattatcgagcacttagattatttagcagagcttggtatcaatggggtttatttaacgcctgtttttgaagcaccgaccaaccacaaatacgacacaattgattataaaaaaattgatccgcactttggagacaaggaaacttttagaaaattagttaaagaagcgcataaacgtggtattcgcattatgctagatgcggtgttcaatcatattggggatacttctccagagtggcaagatgttgttgaaaaagaagaaaaatcagcgtatcgcgactggttccatattcatagtttcccagttcgtcaaaatgaaaatggcaatatcgaaggagaaccaacactttcttatgatacatttgctttcacaacgcatatgccaaaattaaatacggctaacccagaagttcagaagtatttactggatattgcgacttactggattcgtgagtttgatattgacggttggcgtttagacgttgctaatgaagtggatcacgctttttggaaagagtttaagaaggcggctcaagcggaaaaagaagacatttatattcttggtgaaatttggcatgattcatggatttggctacttggagatgaattccacgccgtaatgaattatccatttacacaaacgattattgagaactttattgaagaaaaaattaccccagagcaaatggtttctggcattaatgaacaatatatgcgctacccaaatcaagtgaatgaagtgatgtttaacatgcttgatagccatgatacagcgcgtattttaacacgtgctaataacgatgaggataaagtgaaacaagcgcttgccttcatgttcgcgcacactggttcgccgtgtatttattatggaacagaaatcggcatggacggcggaaatgacccaggttgccgtaagtgtatggaatgggacgaagcaaaacaaaatcaagatatgctagcatttacaaaacaactaatcgctctaagaaaagataatcaagctattatcacatccggtgagttaacttggttagaggcaagcagcgaaacgggcattactgcattttctaaagaattaaatggtgaaaaactacatttccttttcaatcaaacgaaaaaagatcaggatttcacaatttcatttgctaataccgcgatagatatttggaataaccaagctgtatctgataatctaactatcccggcaaaaggatttcttgttattaaagaaaacagctaa

SEQ ID NO: 698 - protein, 591 aa, Listeria monocytogenes EGD-e
MEKAGIYHQPASSYAYSYDAKTLHIRIRTKRLDISKVTLIAADPYLWKDGKWQSESYTMRKIAETEEHDYWFFAITPEHRRLQYGFLLTDTEGETTFYGGRGFFEPTEANLATMDYYFKFPFIHAVDTFEAPEWVRNTIWYQIFPERFANGNPAISPENTLPWGSKDPNTTDFFGGDIEGIIEHLDYLAELGINGVYLTPVFEAPTNHKYDTIDYKKIDPHFGDKETFRKLVKEAHKRGIRIMLDAVFNHIGDTSPEWQDVVEKEEKSAYRDWFHIHSFPVRQNENGNIEGEPTLSYDTFAFTTHMPKLNTANPEVQKYLLDIATYWIREFDIDGWRLDVANEVDHAFWKEFKKAAQAEKEDIYILGEIWHDSWIWLLGDEFHAVMNYPFTQTIIENFIEEKITPEQMVSGINEQYMRYPNQVNEVMFNMLDSHDTARILTRANNDEDKVKQALAFMFAHTGSPCIYYGTEIGMDGGNDPGCRKCMEWDEAKQNQDMLAFTKQLIALRKDNQAIITSGELTWLEASSETGITAFSKELNGEKLHFLFNQTKKDQDFTISFANTAIDIWNNQAVSDNLTIPAKGFLVIKENS

SEQ ID NO: 699 - DNA, 1467 bp, Nostoc sp. PCC 7120
  CDS (1)..(1467): transl_table=11
atgcaaattcaaacaccaaactgggtgaaaaacgctgtattctaccaaatcttccccgatcgttttgctagaagtaaacagccccacaagcgcctgttgcgtgatgcgcgttgggaagactgggatgcgatgcctacgctacaaggatacaaaggcggtgatttatggggcatcatggagcagttagactacattcaagacttaggcattgatgccatttactttacacccatctttcaatctgccagcaatcaccgctatcatacccacgactattatcaagtagacccgatgttgggtgggaatgccgcttttaaggaattactagacgcatcccacgaacgcaatattaaagttgtcctcgatggcgtatttaatcattccagtcgaggatttttctttttccacgacgttttggaaaatggccctcattccccttgggtaaattggttcaagattgaaggctggcctctggcaccatatacaggtgagttgccggcaaattatgtaggttgggctgataatcgcgccttgccagtatttaatcatgacaacccagaagtgcgggaatatattatggaaattgccgaatattggattaaattcggcatcgacggctggcggttggatgtaccatttgaaattaaaactcctggcttttggcaagaattccgcgatcgcgttaaagccattaaccccgaagcttatattgtgggggaagtgtggggagattccagcgagtggctagatgggacgcaattcgacggtgtgatgaattacttatttgccgggccgaccattgcctttgccgcaggcgatcgcgtagtcttagaacaagtccaaagccgcgattatcaaccatatccgcccctattcgctgccgaatacgccaccaaaattcaggaagtactgcaactttacccttgggacattcaacttacccaactcaacttattagcgagtcacgatacagcccgactcctgaccattgctggcggtgatcaagccagtatacaattagctaccctattactacttacctttcctggcgcgccaagtatctactacggcgatgaagtgggtttaccaggaggtatcgaccccgattctcggcggggctttcctttagaagctaactgggatagagaaatttatcagacccaccgtcaattaatagccttacgccgtacttacccagccttacgcacaggtgactatcaagttatttgggcgcaaggtgcattgtatatttttgcccgcaccttaggcaaagaagaattaattattgccgtaaatgtaggtacagcaacagcccaggctaatgtagatgttgctagtttgcagactcagccaaataaaatcctgtacggtcaagcagaatttcactggcacaatacagaagaaacaaaacaactgttcttaagtctccccccacgtagtggctgcattctgggtttaggggattag

SEQ ID NO: 700 - protein, 488 aa, Nostoc sp. PCC 7120
MQIQTPNWVKNAVFYQIFPDRFARSKQPHKRLLRDARWEDWDAMPTLQGYKGGDLWGIMEQLDYIQDLGIDAIYFTPIFQSASNHRYHTHDYYQVDPMLGGNAAFKELLDASHERNIKVVLDGVFNHSSRGFFFFHDVLENGPHSPWVNWFKIEGWPLAPYTGELPANYVGWADNRALPVFNHDNPEVREYIMEIAEYWIKFGIDGWRLDVPFEIKTPGFWQEFRDRVKAINPEAYIVGEVWGDSSEWLDGTQFDGVMNYLFAGPTIAFAAGDRVVLEQVQSRDYQPYPPLFAAEYATKIQEVLQLYPWDIQLTQLNLLASHDTARLLTIAGGDQASIQLATLLLLTFPGAPSIYYGDEVGLPGGIDPDSRRGFPLEANWDREIYQTHRQLIALRRTYPALRTGDYQVIWAQGALYIFARTLGKEELIIAVNVGTATAQANVDVASLQTQPNKILYGQAEFHWHNTEETKQLFLSLPPRSGCILGLGD

SEQ ID NO: 701 - DNA, 1821 bp, Clostridium perfringens str. 13
  CDS (1)..(1821): transl_table=11
atgggaaaagcttatatttatcatgattctcaagataccttttatagggaaccttttggagctgtttctataggttctaaggtaagtttaagattagaatgcgaagagtgtggagaagtttttatagaggtaataaagtttgatggaagtagatattcaatacctatgacaattgaagagcgaagaaatgaatgcataatttataaagggattatagacactacaaactccttaggagtaataaattattactttaaatacattaaggacggatttactaagtattatggaaataatgatgaatgtttaggaggagagggaaagatatattatgattttcctaattattatcaaataacagtttatgaagataataaaattcctagttggtataaggaaggtattatttatcaaatatttgtggatagattttttaatgggaataagaatagtgtgatattaaataaaaagaaaaatagctttatatatggtaattggtatgatgagccaatgtatataagagataataatggaagtattaaacggtggggtttttatggaggtaatttaaggggagtaattgaaaaattagattatataaaatctttaggtgtaaatattatatacatgaatccaatctttgatgctgtgagttgtcataaatatgatactggagattatgaaaatattgataagatgtatggaactaacagtgattttaaggaattgtgccaaaaagctgaggaaaaaggtataaggataatattagatggagtttttagtcatacaggatcagatagtaggtactttaataaatacggaaactatggagagcttggagcctatgaatctaaatactctaaatattataagtggtataggttttatgactatcctaatagttatgaatgttggtgggggtttgaaaatcagcctaatgtagaggaattagaaaagacatattcagattatatagttaatagtgaaaattcaataatagcaaagtggcttagattaggagcaagtggttggaggctagatgtagcagatgaacttccggatgaattcatacaaatgattaaggaaaggatgaaaaatgagaaagaagatagtgtgcttataggagaggtttgggaagatgcttcaaataaggttagctattcaaaaagaagaaaatatttattaggagatgaattagattctgtaacaaattacccttatagagatataatttctaattttttaaatgaagaaataagttcaaaggatttttataaagtaataatgagcataaaagaaaattatccaagagaaaacttttatgcaaatatgaatattctagggaaccatgacacagaaagaatacttacagtattaaaagagaatttaaataagttaaaattagctctatgtcttcaaatgactttacctggagttcccttaatttattatggcgatgaggcaggacttttaggaaataaggatcctgaaaatagaaagacctatccttggggacgagaaaataaggaaatattaagttattatagctttttcggaaactttagaaagaatgaagaggttttaagaaagggagatttttatatttttaaggatacacctgaggatgttattgcttttaagagagtttataaagataaagaaatgataattatagtaaacaggagtaattctagaaaaaccataaccttagatagcgagaaaggaagatataaagataaattttctaaggaagaattttatggtgatggtagcattactttagaagtagaaagagaaaattataaaattttaactaattag

SEQ ID NO: 702 - protein, 606 aa, Clostridium perfringens str. 13
MGKAYIYHDSQDTFYREPFGAVSIGSKVSLRLECEECGEVFIEVIKFDGSRYSIPMTIEERRNECIIYKGIIDTTNSLGVINYYFKYIKDGFTKYYGNNDECLGGEGKIYYDFPNYYQITVYEDNKIPSWYKEGIIYQIFVDRFFNGNKNSVILNKKKNSFIYGNWYDEPMYIRDNNGSIKRWGFYGGNLRGVIEKLDYIKSLGVNIIYMNPIFDAVSCHKYDTGDYENIDKMYGTNSDFKELCQKAEEKGIRIILDGVFSHTGSDSRYFNKYGNYGELGAYESKYSKYYKWYRFYDYPNSYECWWGFENQPNVEELEKTYSDYIVNSENSIIAKWLRLGASGWRLDVADELPDEFIQMIKERMKNEKEDSVLIGEVWEDASNKVSYSKRRKYLLGDELDSVTNYPYRDIISNFLNEEISSKDFYKVIMSIKENYPRENFYANMNILGNHDTERILTVLKENLNKLKLALCLQMTLPGVPLIYYGDEAGLLGNKDPENRKTYPWGRENKEILSYYSFFGNFRKNEEVLRKGDFYIFKDTPEDVIAFKRVYKDKEMIIIVNRSNSRKTITLDSEKGRYKDKFSKEEFYGDGSITLEVERENYKILTN

SEQ ID NO: 703 - DNA, 1725 bp, Thermoanaerobacter tengcongensis MB4
  CDS (1)..(1725): transl_table=11
atgataaaagaggctatattccacaaaagcgatataccttatgcatatcctgtaaataaagaccaattaaaaatagtcttgagaacggcagttttcgatgtggatagggtatacattctttttaaagacaggtatgactggctgggcaaatttaaaataaagcctatgaccttagttcacactaacgagctttttgactattatgagactactcttgaattaaataagaggtttttgtactttttttatttagtttcagaaacgggagaaaaactttattacacagaagctggttttttcaaaaagaggccagaggatagcttctggggttttttccactatccctatataagggaaaaggatatattttctcctccggattgggcaaacgagtgcatagtgtatcagatatttccagacagattcaacaatggagacagaactaatgaccccgaaaacgtaaagccatggggggaaaagccgactgcagattctttttttggaggggatttacagggaataatcgacaaaatagattatttaaaagagttagggataaatgccatttatttaactccaatatttttgtctccttctactcacaaatacgacaccacggattattacacgatagaccctcattttggtgacacggaaaaagctaaagaattggtgaggaagtgtcatgacaatggcataaaagttatattcgatgcagtgttcaaccactgtggatacgacttttttgcatttcaggatgtggttaaaaatgggccgaagtcaaagtactgggattggttcaatgtgtacgaatggcccattaaaacgcatcccaaacctacttacgagacttttggcgagaatgtgtggagaatgcctaagcttatgactaaaaacccggaagtgcaaaagtacctactggaagtggctgaatactggattaaagaagtagacattgacggctggcgattggacgttgccaacgaaatagaccatcacttctggagaaagtttagagaggttgtaaaaaatgccaaaaaagatgccataatagtaggagaagtgtggcatgatgcttctccgtggttaagaggggaccagtttgactctgtcatgaattatccttttagaaatgcagttgtagacttttttgcgaagaggaaaataagtgctgtaaaattcaacacactgataactgagcagcttatgagacacatggatagcgttaatagagtcatgtttaacctcataggtagtcacgacactgaaaggtttttgactctcgcaaatggcatggtggcgcggatgaaattagctttggttttccagtttacatttgtgggagtgccgtacatctactatggagacgaagctggaatggtgggaggatttgaccctgactgcagaaggtgcatgatatgggaggaggaaaagcagaacaagggactttttgagttttacaaaaagctcatccgcataagaaaggagcatgaagaacttaagtatggcaatttcaccactttgtacgctgttggaagggtgtttgcttttagaagggaatataaaggaaattcaattgtggtgattataaacaacagcagcaaagaggaagtgatatttttagaagaggcgggaggaaaagaggatatattaaaaatgggagaattaaaaaggagtggcaatttgctgtatcttaagcctaacactgcctatattttgaagtag

SEQ ID NO: 704 - protein, 574 aa, Thermoanaerobacter tengcongensis MB4
MIKEAIFHKSDIPYAYPVNKDQLKIVLRTAVFDVDRVYILFKDRYDWLGKFKIKPMTLVHTNELFDYYETTLELNKRFLYFFYLVSETGEKLYYTEAGFFKKRPEDSFWGFFHYPYIREKDIFSPPDWANECIVYQIFPDRFNNGDRTNDPENVKPWGEKPTADSFFGGDLQGIIDKIDYLKELGINAIYLTPIFLSPSTHKYDTTDYYTIDPHFGDTEKAKELVRKCHDNGIKVIFDAVFNHCGYDFFAFQDVVKNGPKSKYWDWFNVYEWPIKTHPKPTYETFGENVWRMPKLMTKNPEVQKYLLEVAEYWIKEVDIDGWRLDVANEIDHHFWRKFREVVKNAKKDAIIVGEVWHDASPWLRGDQFDSVMNYPFRNAVVDFFAKRKISAVKFNTLITEQLMRHMDSVNRVMFNLIGSHDTERFLTLANGMVARMKLALVFQFTFVGVPYIYYGDEAGMVGGFDPDCRRCMIWEEEKQNKGLFEFYKKLIRIRKEHEELKYGNFTTLYAVGRVFAFRREYKGNSIVVIINNSSKEEVIFLEEAGGKEDILKMGELKRSGNLLYLKPNTAYILK

SEQ ID NO: 705 - DNA, 1830 bp, Yersinia pestis KIM
  CDS (1)..(1830): transl_table=11
atgcttagtggttggcaccttccggtctcgccttttgttcgtttggcagacgacgcattacatatcacgctctggttgcaaggtgatagtttacctgcgcaagtctttctgcgttgtgagccagataatgaagagtggctgctcactatggaggggcatgagagccatgatcgttggcgctatagcgtttctttaccgttatatgaggggcagccaacccggcgctactgcttcaaactattatgggatgaccgccaacagtggtttggcccgttggggttctcggtgattcctccagcacagttggcacagtttgctgtagatgtacccgatagcgggcctgattgggtcgcggaccaagttttttatcagatcttccccgatcgctttgccagtagtcaggcagatcatggtgtgcaggaggggagttatattcatcatgcggccggttgcccggtatctcgccgcgagtggcagcagccattggatgatgtgcatgccgcatcgacattttatggtggcgatctggccggtattagtcagaaaatcccttactttcaacaactgggggttacggcactgtatttgaaccctatttttaccgctcccagtgtgcataaatatgatactgaagattattatcaggttgatccctacttggggggagagcgtgatttcttgcaattgcgagccgctacccgtgaagtaggaataaagttggtgctcgatggcgtgtttaaccacacgggtgattctcatcgctggtttgatcgctatcaacaaggggaaaacggcgcctgccatcacgaagattcgccttatcgtggttggtttacgttcctccctgatggacgagcattagattggaaaggtaatgccagtttgccaaaacttaattttgccaatgaagaggtcgctgaacgaatctatcgcagtgatgacagcgtcgtgcgttattggttacggccaccatacagtattgatggctggcgtctggatgtcgtacacatgctcggggaagatggcggcgctaaagggaatttgcaccatctgcacggtatctatcaggcagcaaaagaagaaaatccgcaggcttatattctgggcgaacattttggcgatgcacgtaattggttgcacgctggagtggaagacgcggcaatgaattatatgggttttgctttgccggtccgcagttttctcgccgagctagatgtggcttgccatcctataaaattggatgctgcggattgcgcctactggatggatgagtaccgcgcaggattgccccatagccagcaactccgtttatttaatcaattagatagccatgatactgcccgttttcttaccttattaaagggtgataaaacccgtatgcaaatggcgctaatatggttgtttagttggattggtgtgccttgcctattttatggtgatgagattgggctggatggagggaatgatccgttctgccgcaaaccgttcccgtgggatgaggctcagtgggatcatgacctattatcactgtgtcaacgtatggcggctttacgccacaaaagcatagcgttgcggcgcggggggtgtcaggtgatccatgccagtggtgattccctggtctttattcgtagctatcaaactgagcgtgtgatggtggcgatacaacgttccgatgatgcggatattttcctgcccgcctctcctttactcaatgtggctgagtggcagcgtctggaaggtggaggagacctggctgtcagtgagactggggtaaacatggggctggagggtaagagtgttaccttgtggtgtggtgttggtgagtgctaa

SEQ ID NO: 706 - protein, 609 aa, Yersinia pestis KIM
MLSGWHLPVSPFVRLADDALHITLWLQGDSLPAQVFLRCEPDNEEWLLTMEGHESHDRWRYSVSLPLYEGQPTRRYCFKLLWDDRQQWFGPLGFSVIPPAQLAQFAVDVPDSGPDWVADQVFYQIFPDRFASSQADHGVQEGSYIHHAAGCPVSRREWQQPLDDVHAASTFYGGDLAGISQKIPYFQQLGVTALYLNPIFTAPSVHKYDTEDYYQVDPYLGGERDFLQLRAATREVGIKLVLDGVFNHTGDSHRWFDRYQQGENGACHHEDSPYRGWFTFLPDGRALDWKGNASLPKLNFANEEVAERIYRSDDSVVRYWLRPPYSIDGWRLDVVHMLGEDGGAKGNLHHLHGIYQAAKEENPQAYILGEHFGDARNWLHAGVEDAAMNYMGFALPVRSFLAELDVACHPIKLDAADCAYWMDEYRAGLPHSQQLRLFNQLDSHDTARFLTLLKGDKTRMQMALIWLFSWIGVPCLFYGDEIGLDGGNDPFCRKPFPWDEAQWDHDLLSLCQRMAALRHKSIALRRGGCQVIHASGDSLVFIRSYQTERVMVAIQRSDDADIFLPASPLLNVAEWQRLEGGGDLAVSETGVNMGLEGKSVTLWCGVGEC

SEQ ID NO: 707 - DNA, 1752 bp, Oceanobacillus iheyensis HTE831
  CDS (1)..(1752): transl_table=11
atgctaaaagaagcagtatttcatcgaccaaagaataattatgcttacctttacaaagagaatacgttacacattcgtttacaaacaaagaaagatgatgtagtaaaagccacacttatctatgcagatccttataattgggatgattcaggatggatttataacaaggcagacatgcgtctcatagcttccgatcagctattcgattattggcaaattgaaatttattgtaaaacacgtcgaataagatatggatttcaattatctgatactaaagaaactcttatttatacagagaaaggattttataaagaaattccaaatgatgacactgcttattacttctgcttcccttttttaaacccaatagatcaatttcaagcaccagaatgggtaaaggaaactgtatggtatcaaatttttcctgaacgatttgcgaacggaaatgaaacaattaatcctcctggaactttaccttggggaagcactacccctacacctacagatttttttggtggtgactttcaaggtataatcaatcacttggattatcttgtagatttaggtatttccggtatttattttacgcctatatttaaagcattttctaaccataaatacgatacgattgactatatggaaatcgatcctcaatttggggataaacagacatttcgaaagttagttaaagcttgtcatcaacgaggaattcgcattatgcttgatgctgtatttaatcatagtggctatttctttgaaccatttcaggatgtgttaaaaaaccaagagaagtctatttataaggaatggtttcatatcgagagttttcctttgagaacagacccagcaccaaactatgacacctttgcatatgtaggttcaatgccaaaactaaatacagagcacccggaagtgaaatcatatttacttaaagtagcatcatattggattgaagagtttgatatcgatgggtggcgattagacgtagctaatgaagtggatcaccaattttggagagatttccgtagacaagtgaaatccataaagccagatgtctatattctcggagaaatatggcatgattcgatgccctggttacaaggagatcaatttgacgcagtaatgaactatccacttaccagtgctgcacttgattttattgcaaaggaaaaaatagatgttaaagaatttgtccaacaaatttctaatgttctactttcttatccacagaacgtgaatgaagtagcatttaatctattaggcagtcatgatactcccagagttttaacacattgcaacaatcaagtcgaaaaagcaaaacttctatatatattattattaacgatgccaggttctccttgtatttattatggagatgaaattggaatgactggagaaggggatcctggttgcagagaatgtatggtttgggacgagaatgaacaaaatgtagaattaaaatctttccttaaaaaattaattcatgtgcggaaaacggaaaaggctgttgcaaatcaaggagaattttcatttgtaaaaactagtgataattatttcatttataaactttttcaacagcatatggaaatttatattattataaacccaagtaatcaggctctcgaagtatcacttccggtaaccaagtggaacagtgccttcgatttatgggaggaagatgatttcaatattaacactccaataaaatgtgaggaaaatagtttcaaaataatcaaagtaaattattcataa

SEQ ID NO: 708 - protein, 583 aa, Oceanobacillus iheyensis HTE831
MLKEAVFHRPKNNYAYLYKENTLHIRLQTKKDDVVKATLIYADPYNWDDSGWIYNKADMRLIASDQLFDYWQIEIYCKTRRIRYGFQLSDTKETLIYTEKGFYKEIPNDDTAYYFCFPFLNPIDQFQAPEWVKETVWYQIFPERFANGNETINPPGTLPWGSTTPTPTDFFGGDFQGIINHLDYLVDLGISGIYFTPIFKAFSNHKYDTIDYMEIDPQFGDKQTFRKLVKACHQRGIRIMLDAVFNHSGYFFEPFQDVLKNQEKSIYKEWFHIESFPLRTDPAPNYDTFAYVGSMPKLNTEHPEVKSYLLKVASYWIEEFDIDGWRLDVANEVDHQFWRDFRRQVKSIKPDVYILGEIWHDSMPWLQGDQFDAVMNYPLTSAALDFIAKEKIDVKEFVQQISNVLLSYPQNVNEVAFNLLGSHDTPRVLTHCNNQVEKAKLLYILLLTMPGSPCIYYGDEIGMTGEGDPGCRECMVWDENEQNVELKSFLKKLIHVRKTEKAVANQGEFSFVKTSDNYFIYKLFQQHMEIYIIINPSNQALEVSLPVTKWNSAFDLWEEDDFNINTPIKCEENSFKIIKVNYS

SEQ ID NO: 709 - DNA, 1818 bp, Shigella flexneri 2a str. 301
  CDS (1)..(1818): transl_table=11
atgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccaatgcataagcagcgcagtcagccgcagccaggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtacctgatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcacaatcttggcacggggggagcttgtcacaactctgaatcgccctggcgcgactggtactcgtttagtgatgatggcacggcgctcgactggcttggctatgccagcttgacgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgcagggatcaccgaagcggcgaaagaaacccagccggaagcgtatattgtcggcgaacattttggcgatgcacggcaatggttacaggccgatgtggaagatgctgccatgaactatcgtggcttcacattcccgttgtggggatttcttgccaataccgacatctcttatgatccgcagcaaattgacgcccaaacctgtatggcctggatggataattaccgcgcagggctttctcatcaacaacaattacgtatgtttaatcagctcgatagccacgatactgcgcgatttaaaacgctgctcggtcgggatattgcgcgcctgccgctggcggtggtctggctgttcacctggcctggtgtaccgtgcatttattacggtgatgaagtgggactggatggtaaaaacgatccgttttgccgtaaaccgttcccctggcaggtggaaaagcaggatacggcgttattcgcgctgtaccggcgaatgattgtgctgcgtaagaaaagtcaggcgctgcgtcgtggcggctgtcaggtgctgtatgcggaagataacgtagtggtatttgtccgcgtgctgaatcagcaacgtgtactggtggcaatcaaccgtggcgaggccagtgaagtggtgctacccgcgtcaccgtttctcaatgccgtgcaatggcaatgcaaagaagggcatgggcaactgactgacgggattctggctttgcctgccatttcggctacggtatggatgaactaa

SEQ ID NO: 710 - protein, 605 aa, Shigella flexneri 2a str. 301
MMLNAWHLPVPPFVKQSKDQLLITLWLTGEDPPQRIMLRTEHDNEEMSVPMHKQRSQPQPGVTAWRAAIDLSSGQPRRRYSFKLLWHDRQRWFTPQGFSRMPPARLEQFAVDVPDIGPQWAADQIFYQIFPDRFARSLPREAEQDHVYYHHAAGQEIILRDWDEPVTAQAGGSTFYGGDLDGISEKLPYLKKLGVTALYLNPVFKAPSVHKYDTEDYRHVDPQFGGDGALLRLRHNTQQLGMRLVLDGVFNHSGDSHAWFDRHNLGTGGACHNSESPWRDWYSFSDDGTALDWLGYASLTKLDYQSESLVNEIYRGEDSIVRHWLKAPWNMDGWRLDVVHMLGEAGGARNNMQHVAGITEAAKETQPEAYIVGEHFGDARQWLQADVEDAAMNYRGFTFPLWGFLANTDISYDPQQIDAQTCMAWMDNYRAGLSHQQQLRMFNQLDSHDTARFKTLLGRDIARLPLAVVWLFTWPGVPCIYYGDEVGLDGKNDPFCRKPFPWQVEKQDTALFALYRRMIVLRKKSQALRRGGCQVLYAEDNVVVFVRVLNQQRVLVAINRGEASEVVLPASPFLNAVQWQCKEGHGQLTDGILALPAISATVWMN

SEQ ID NO: 711 - DNA, 1839 bp, Vibrio vulnificus CMCP6
  CDS (1)..(1839): transl_table=11
atgaccctaccttttctttttcatgcgcaaacgccggattatttccgcgttgagaatcaaatcgctcacgttaccttaagaactcagcctgaaggaattcaagccgtctacctgcggcacgagcctgacaatgaagagtacttagtagaaatgcagcgagtctctaagttaggggaactcgatggctggcaagcgtcattccctttgaataaagaccgagagatcacccagtacgttttcaaagtgatcacagaaggtgccactgtctggttagacgctcgtggcgtacagaaacggatgccaggcagcgagtaccatttcaaatacaaccaatctcatcagccgccagagtgggtgagtgagcagattttctaccaaattttccctgatcgattctgtaatggtaacccagagatcagcgttaaaagtggcgaatactcggtaaaaaatggcacacgccctgtggtcgcaaaagagtggggagcggccgttgacaaacacaatggctatgggggttgtgagttttatggcggggacttggctggcattcgcagcaaattggattacctgcaaaccttgggcgtgacagcgctctatctcaatccgattttttcggcgccgagcaatcacaagtacgacaccactgattacttaaccattgatccgcatttgggaagcaatcaagagtttgcagagttgagcgaagcgcttcatcaacgcggtatgaaaattgtgcttgatgccgttttcaatcacacctcatgtgagcacccttggtttgacaaaaatggggtaggtgagataggggcctatcaccacatcgaatcgccttatcgccactattattttttcgaagacggtagccaaaattatattggctggaagggcgttgacagtttaccagtactgaattttgaaaatgcggaggtacgtaattacatttatgccagcgaacacgcggccattcgccactggttgaaagcaccctatcgaatcgatggttggcgttttgacgtgatccacatgcttggagaaggtgaaggggcgcgcaacaatgcctactatgttaagcagttccgcaatgcgactaaacaagaaaaccctcaagcttatgtattaggggagcatttcttcgaggcgagcaagtggctccaaggcgatcaagaagacggctcgatgaattactacggctttgcccatccagtgagagcattattggcccaaaaagacattgcctaccatcctattgagatcgactgcatcgattttgttgattggctaaatgaatcacgcgctaaagtaccttggcttaaccagctcagccagttcaatcaacttgacagccacgataccgcacgttttattaccttgttggaaaatgaccaagcgcgcatgaacattgctctcggcttgctgttcacttatgtcggaaccccttgtatctattatggtagtgaagttggactggaaggtgagaatgacccagataaccgccgctgtttcccgtgggagcgtgttggtcatgtggagacgttccaatatcaccaacgtctcattgaacttcgcaaaacgtctaaggcgctgcagcaagggtcgatccaatttttgcatgttgagccaacgtcgttcagttttgctcgtcagtatggtgaagacactctgcttgtgatggtcaacttagattcgaaggcatgctctatgacgctgccaatttggcaacttggaaagccgcaaggacgtctggtttccctattgggtaatgaaagtgctttgcaagtaaatagtaaagttgtggttaatatctcttctgaatccattcaaatttggaaacttgagtga

SEQ ID NO: 712 - protein, 612 aa, Vibrio vulnificus CMCP6
MTLPFLFHAQTPDYFRVENQIAHVTLRTQPEGIQAVYLRHEPDNEEYLVEMQRVSKLGELDGWQASFPLNKDREITQYVFKVITEGATVWLDARGVQKRMPGSEYHFKYNQSHQPPEWVSEQIFYQIFPDRFCNGNPEISVKSGEYSVKNGTRPVVAKEWGAAVDKHNGYGGCEFYGGDLAGIRSKLDYLQTLGVTALYLNPIFSAPSNHKYDTTDYLTIDPHLGSNQEFAELSEALHQRGMKIVLDAVFNHTSCEHPWFDKNGVGEIGAYHHIESPYRHYYFFEDGSQNYIGWKGVDSLPVLNFENAEVRNYIYASEHAAIRHWLKAPYRIDGWRFDVIHMLGEGEGARNNAYYVKQFRNATKQENPQAYVLGEHFFEASKWLQGDQEDGSMNYYGFAHPVRALLAQKDIAYHPIEIDCIDFVDWLNESRAKVPWLNQLSQFNQLDSHDTARFITLLENDQARMNIALGLLFTYVGTPCIYYGSEVGLEGENDPDNRRCFPWERVGHVETFQYHQRLIELRKTSKALQQGSIQFLHVEPTSFSFARQYGEDTLLVMVNLDSKACSMTLPIWQLGKPQGRLVSLLGNESALQVNSKVVVNISSESIQIWKLE

SEQ ID NO: 713 - DNA, 1827 bp, Vibrio parahaemolyticus RIMD 2210633
  CDS (1)..(1827): transl_table=11
atgtctttgccatttctctttcatagccagacggttgatggtttagccttcgatggtaaacgcgtgaaggtctgtctaaaaacagaagcgttaacatttgatgctgtttatgtgcgtattgagccagacaacgaagaataccttgtcgccatggtgcaatgcggtagagctggagagttactgctgtgggaagtatcgttcgagccgaatagagatcgagacatcacccactatgtatttaaagtcgttagaaatggtcagcaatattggctagacgcacgtggagtgcaaaaacgtattccgcccaaagaatttcatttcaaattgaatgtaaaccatcaaccgccaaagtgggttcaagaacaagttttctatcagatttttcctgatcgttttgccgcgagtcaaagtgagtctgcgattcgtgaagcgtactacgagtacgatcctgatgctgagattaaaatgtggggagaaccagtagggaatcaccaaaactctggggcacgtgagttcttcggtggtgatctaaaaggcgttgagcaaaagcttggataccttgaacaattgggtgtgaccgcactgtacttcaatccgattttttcctcgccaagtaaccataagtacgacaccacggattatttcacgattgatcctatgctcggcaccaacgagcattttgcgtcattgtgcgaaaaaatccgcagcaaaaacatgaagatcgtattggatgcggtctttaaccatacttctgtgcatcacccttggtttgatattcagcagaaagggaaaggcgcgtacgggaatcctaaatccgattttcgcgactattacttctttgatggggagagtaatcactatattggctggaaaggtatcgacaatctgccggtattgaattttgagaatcacgaagtcagagaatatatctaccaaggtgaggcgtcggttatcaaacattggctgaagccaccatattccgtggatggctggcgttttgatgtcattcatatgctaggtgaaggggagggggcgaaaaataatgctcactacgtgaaagcatttcgccaagcgaccaaatccgttaatccgaatgcttatgtgttaggtgagcatttttttgaggcgactcaatggttgcaaggggagcaagaagatggcgcgatgaactactacggttttgcccatcctgttcgagcgtttattgcgcatcaagacatcacgtacgacccaattgatatagatggttttgagttcaaagcgtggttggatgaagccagagcaaaagttccttttgccaatcagctctcacaactcaatcaacttgatagccatgacacggcgcgttttctcaccttggtgaatggggatgagaaaaaaatgaaaatcgcgttggccttactcatgacttatgtcggtgcgccatgcatttattatggtagtgaagtcggtcttgagggaagctttgacccagataacagacgttgtttcccttggcatttagttcagggttcgccttggctccacctgtaccaacagtggattgaaattcgcaaacagttccaagctctacaatctggcagcatgcaatggctgtattgtgacgaaagggcatttgcttatgcaagacagcttggtgaagagacgatcattgttgcagtcaatattggtctacaagaaagcacgattgacctaccattgtggcagttaggcttgaatgcgaaacacttgcatcaattattagataagtgtgaaataattgattatgaaggtcatgtttctgtcaatatggcagcattaagtatcaatttgtggcaagtgaagtga

SEQ ID NO: 714 - protein, 608 aa, Vibrio parahaemolyticus RIMD 2210633
MSLPFLFHSQTVDGLAFDGKRVKVCLKTEALTFDAVYVRIEPDNEEYLVAMVQCGRAGELLLWEVSFEPNRDRDITHYVFKVVRNGQQYWLDARGVQKRIPPKEFHFKLNVNHQPPKWVQEQVFYQIFPDRFAASQSESAIREAYYEYDPDAEIKMWGEPVGNHQNSGAREFFGGDLKGVEQKLGYLEQLGVTALYFNPIFSSPSNHKYDTTDYFTIDPMLGTNEHFASLCEKIRSKNMKIVLDAVFNHTSVHHPWFDIQQKGKGAYGNPKSDFRDYYFFDGESNHYIGWKGIDNLPVLNFENHEVREYIYQGEASVIKHWLKPPYSVDGWRFDVIHMLGEGEGAKNNAHYVKAFRQATKSVNPNAYVLGEHFFEATQWLQGEQEDGAMNYYGFAHPVRAFIAHQDITYDPIDIDGFEFKAWLDEARAKVPFANQLSQLNQLDSHDTARFLTLVNGDEKKMKIALALLMTYVGAPCIYYGSEVGLEGSFDPDNRRCFPWHLVQGSPWLHLYQQWIEIRKQFQALQSGSMQWLYCDERAFAYARQLGEETIIVAVNIGLQESTIDLPLWQLGLNAKHLHQLLDKCEIIDYEGHVSVNMAALSINLWQVK

SEQ ID NO: 715 - DNA, 1818 bp, Salmonella enterica subsp. enterica serovar Typhi Ty2
  CDS (1)..(1818): transl_table=11
atgttgaatgcctggcacttaccggttgccccgtttgttaagcaacataacgataaattaaccattacgctgtggctgagcggagaaaatccgccgtctcgcgtgacgttgcgctcagaattcgataacgaagaaatctcactggcgatgcgcaaacagcgccgccagccgcagccgggcgtgacggcgtggcgagcgacgctcaatatcgcgttagggcagccccgtcgccgttacagctttaaattgctttggcatgaccgccagcgatggtttacgccgcagggatttagctgctttccacccgcgcgtctggaacaatttgcggttgatgtgccggatagcggcccgcagtgggtcgccgatcaaattttttatcagatcttcccggatcgttttgcccgcagcgcgacgcgtgaagccgatcaggaccgagtgtattaccatcatgccgcgggtcaggagattgtgctgcgcgactgggacgatcctttaaccccccaggcgggcggttccaccttttacggcggctgtctgaatggcatttgtgagaagctgccgtatctgaaaaaactgggcgtcacagcgctatatctgaatccggtatttaccgcgccgagcgtccataagtacgacacggaagattatcgccatgtcgatccgcaatttggcggcgatcgggcgctgctacgcctgcggcgtgaaacgcaagcacagggcatgaggctggtgctggatggcgtgtttaaccatagcggcgactcgcatgcgtggtttgacaggcataaccgcagcactggcggcgcgtgccatcacccggactcgccgtggcgcgactggtactccttttcaccacaaggcgtggcgctggactggctgggttatccgagcctgccgaaactcgattatcaatcagaaacgctggtggatgagatctatcgcggtgaggacagtatcgttcgtcactggctaaaggcaccgtggaatatggacggctggcggctggatgtcgtacatatgctgggcgaggcgggcggggcgcgccacaatttgcagcacgtcgccggcattacccgggcggcaaaagaggcgcagcctgaagcctatattgtgggggaacatttcagcgatgcgcggcagtggctacaggccgatgcggaagatgccgccatgaattatcgcggcttcaccttcccgctgtggggatttctcgccaatactgatatcgcttacgaaccacagcatattgatgcccggacctgtatcgcgtggatggataactaccgcgccggattatcgcaccagcagcaactgcgcatgtttaatcaactcgacagccatgatactgcgcgctttaaaaccctgctgggtaaagacgcggcgcgcctgccgctggcggtggtctggctgtttacctggcccggcgtgccatgtatttattacggcgatgaagtcggcgtggacggcgcaaatgaccccatgtgccgcaaaccgttcccatgggatgaacgcaagcaggacggcaacttgctggcgctgtaccagcgtatggcgaaactgcgccagagcagtctggcgctgcgtcgtggcggatgccaggcgctgtatgccgaaggtgacgtagtggtattcgtgcgagtttatcagcagcagcgggcgctggtggcgattaaccggggcgaggcctgtgaagtggcgctggaagcgttgccgttgctgaacgtggccggatggcaatgtaaaacgggaagcggtgacatccgcgagggaagacttagtttacccgcgatttccgcgacggtatggatgaatcgttga

SEQ ID NO: 716 - protein, 605 aa, Salmonella enterica subsp. enterica serovar Typhi Ty2
MLNAWHLPVAPFVKQHNDKLTITLWLSGENPPSRVTLRSEFDNEEISLAMRKQRRQPQPGVTAWRATLNIALGQPRRRYSFKLLWHDRQRWFTPQGFSCFPPARLEQFAVDVPDSGPQWVADQIFYQIFPDRFARSATREADQDRVYYHHAAGQEIVLRDWDDPLTPQAGGSTFYGGCLNGICEKLPYLKKLGVTALYLNPVFTAPSVHKYDTEDYRHVDPQFGGDRALLRLRRETQAQGMRLVLDGVFNHSGDSHAWFDRHNRSTGGACHHPDSPWRDWYSFSPQGVALDWLGYPSLPKLDYQSETLVDEIYRGEDSIVRHWLKAPWNMDGWRLDVVHMLGEAGGARHNLQHVAGITRAAKEAQPEAYIVGEHFSDARQWLQADAEDAAMNYRGFTFPLWGFLANTDIAYEPQHIDARTCIAWMDNYRAGLSHQQQLRMFNQLDSHDTARFKTLLGKDAARLPLAVVWLFTWPGVPCIYYGDEVGVDGANDPMCRKPFPWDERKQDGNLLALYQRMAKLRQSSLALRRGGCQALYAEGDVVVFVRVYQQQRALVAINRGEACEVALEALPLLNVAGWQCKTGSGDIREGRLSLPAISATVWMNR

SEQ ID NO: 717 - DNA, 1767 bp, Enterococcus faecalis V583
  CDS (1)..(1767): transl_table=11
atgaacactgctgcaatctaccatcgtccagaaagtgaatttgcttatctttatacagaagaaaccatgcatattcgtttgcgtacggcaaaaggcgacattgcctctgtccaattagtgcaaggagatccttatcttttagggaaagaaaagtggtaccaacagtcgttaaccatggagaagttagtatctacggagttatatgattactggtttattgcattaagtgcaaaatttaaacgcctttcatatgcttttactttagtaggggcggatggtttgagggcgttttatggcgaacacggcatttatcctttagaagaaaagtatttagagatggcgaataattattttcggatgccgtattttcatgaaatcgatcgttttaaagcacctgaatgggtaaaagaaacggtttggtatcaaatatttccagagcgttttgcaaatggtgatctcgccaatgatcctgaagggacgttgccgtggggatctaaaagaccagatcgacaagatttttttggtggggatttgcaaggggtgctagatcatcttgattacattgaagatttaggtgttaacggcttatatttttgcccaatttttgaagcgttttctaatcacaaatatgatacgattgattatttaaaaattgacccagcttttggtgatggtgctacctttaagcgtttagtcgaagagtgtcatcgacggggcatcaagattatgttggacgccgtttttaaccatatgggggacacttcgcctcaatggcaagatgtgttaaaaaatggccaggactcaatttatgccgattggttccacgtaaatgagtttccagctagctatgaagaaagtgctgattttgaagaagcaagcaacattacctatgatacttttgcattcactccgcatatgcctaaattaaatacagcaaatccagaagtgcaagcctatcttttagaaattgctcgttattggattgaggaatatgatattgacgcctggcgtttagatgtggcaaacgaagtggatcatgcgttctggaaaaaattccggcaaacatgtgatgacgcaaaagaagatttttatattttaggagaaatttggcactcgtcgcaaagctggctccaaggagacgaatttcatgcagtgatgaattatgcatacacagatgcgattatgggctactttgtcaagcaagaactgtccttggaaaagatgctttctgaaatgaacaaccagttaatgctctatcgacaacaaacgaatcaaatgcagtttaatgttttagattcccacgatacaccacgcttattgcatgaaacgaaagaggataaagagctgatgcgccaagtattagcgtttacgtatattcaaccaggtgtcccttgtctttactatggtgatgaaattggtatgacaggtgatatggatcctgattgtcgtcgttgtatggtttgggaggaaaatcagcaagatttggatttgaaggaatttgtaaaatcattgattgcccttcgcaaaaagtatgcggctgttttttctggtggaacaatcgattggacaggaacttcttttgaaacggggttgattagactcgcttgtcgtttggaggaacagacgatttatgggatttttaatactggccaagagacacaatttgtcgatagaactgatcgagaagttttgctaagttcttctatcgaaattgcttcagaacagataatggttttaccaaaaggttttcttttatatcaagcataa

SEQ ID NO: 718 - protein, 588 aa, Enterococcus faecalis V583
MNTAAIYHRPESEFAYLYTEETMHIRLRTAKGDIASVQLVQGDPYLLGKEKWYQQSLTMEKLVSTELYDYWFIALSAKFKRLSYAFTLVGADGLRAFYGEHGIYPLEEKYLEMANNYFRMPYFHEIDRFKAPEWVKETVWYQIFPERFANGDLANDPEGTLPWGSKRPDRQDFFGGDLQGVLDHLDYIEDLGVNGLYFCPIFEAFSNHKYDTIDYLKIDPAFGDGATFKRLVEECHRRGIKIMLDAVFNHMGDTSPQWQDVLKNGQDSIYADWFHVNEFPASYEESADFEEASNITYDTFAFTPHMPKLNTANPEVQAYLLEIARYWIEEYDIDAWRLDVANEVDHAFWKKFRQTCDDAKEDFYILGEIWHSSQSWLQGDEFHAVMNYAYTDAIMGYFVKQELSLEKMLSEMNNQLMLYRQQTNQMQFNVLDSHDTPRLLHETKEDKELMRQVLAFTYIQPGVPCLYYGDEIGMTGDMDPDCRRCMVWEENQQDLDLKEFVKSLIALRKKYAAVFSGGTIDWTGTSFETGLIRLACRLEEQTIYGIFNTGQETQFVDRTDREVLLSSSIEIASEQIMVLPKGFLLYQA

SEQ ID NO: 719 - DNA, 1761 bp, Bacillus anthracis str. Ames
  CDS (1)..(1761): transl_table=11
atgcttaaagaagccatttatcataggccaaaagataattacgcatacgcttacgatgaaaaaacgattcacatccgaatacgtacgaaaagagacgatgttcaaagcaccactcttatttatggtgatccttatgaatggaaagacgggaagtggatttcttcaagtacaccgatgaaaaaaactggttctactgcattgtttgattattggttcatttccatcgagccgaaatttaagcgcttacgttatggatttgaattaaaaaacgatacagacactcttatttatgcagagcgaggatttttttctaccactccaaatgatgacgttggtaactttttctgttttccatttattcatgcaaatgatgtattcaaagcaccttcttggattaaagatactgtttggtatcaaattttcccagaacggttcgctaatggagatcatacgctgaatccagaaaacacccttccttggggcagcgctgagccaactccaactaattttttcggtggagattttgctggtattattcaaaaccttgattaccttgttaagcttggaatttcaggaatatatttcacacctattttcaaagcacattcaaaccataaatatgacacaattgactacatggaaatcgatccacaatttggtacaaaagaaacattcaaagaactcgttcaggcatgtcatacacacggtataaaagtaatgctcgatgctgtattcaatcacagtggatactttttcgataaatttcaagacgtactacaaaatggtgagcagtcagcatataaagaatggttccatattcatgagttcccaattagaactgagccactcccgaattatgatactttcgcgtttacaccgtatatgccgaaattaaacacagcgcacccggatgtaaaagaatacttacttgaagtagggcgttattgggtgagagaattcaatatagacggttggcgccttgatgtagcaaatgaagtcgaccataacttttggagagaatttcgaagtgagataaaagcattaaattctgaagtatatattttaggagaaatttggcacgatgcacttccatggctacaaggagatcaattcgatgctgtcatgagctatcctgttacaaacgccctactgtcttactttgctaacgattccattaaggcaaatgaatttatgaaacaaattacagaatctctacattcctactctatgaatgtaaatgaagcagcatttcatttattagatagccatgatacaccaagaattttgacaacatgtaacggagataaaaataagttaaaattactttatgtattccatctttctttcatcggctctccttgtatttattatggagacgaaattggtatggacggcggtatggacccagattgtcgcaaatgtatggtttgggatacggaagaacaagatcatacattatttacacatgtacaaacattaatttcattacgaaagcaatataaagcatttggaggacatggtactttccaattcattgaagcaaatgatgaatataattatatttcttatacgaaaacatatgaagatgaaacgatctttttcgttttaaatccgactaatagtgatattacagcttcactccctctccatgttactggaaagaaaatcattaatatttatacaaacgaagaattttcagcggaagcaagtgtattacaagttacacttcctccatatggattctccatattaaaatggtaa

SEQ ID NO: 720 - protein, 586 aa, Bacillus anthracis str. Ames
MLKEAIYHRPKDNYAYAYDEKTIHIRIRTKRDDVQSTTLIYGDPYEWKDGKWISSSTPMKKTGSTALFDYWFISIEPKFKRLRYGFELKNDTDTLIYAERGFFSTTPNDDVGNFFCFPFIHANDVFKAPSWIKDTVWYQIFPERFANGDHTLNPENTLPWGSAEPTPTNFFGGDFAGIIQNLDYLVKLGISGIYFTPIFKAHSNHKYDTIDYMEIDPQFGTKETFKELVQACHTHGIKVMLDAVFNHSGYFFDKFQDVLQNGEQSAYKEWFHIHEFPIRTEPLPNYDTFAFTPYMPKLNTAHPDVKEYLLEVGRYWVREFNIDGWRLDVANEVDHNFWREFRSEIKALNSEVYILGEIWHDALPWLQGDQFDAVMSYPVTNALLSYFANDSIKANEFMKQITESLHSYSMNVNEAAFHLLDSHDTPRILTTCNGDKNKLKLLYVFHLSFIGSPCIYYGDEIGMDGGMDPDCRKCMVWDTEEQDHTLFTHVQTLISLRKQYKAFGGHGTFQFIEANDEYNYISYTKTYEDETIFFVLNPTNSDITASLPLHVTGKKIINIYTNEEFSAEASVLQVTLPPYGFSILKW

SEQ ID NO: 721 - DNA, 1452 bp, Prochlorococcus marinus str. MIT 9313
  CDS (1)..(1452): transl_table=11
atgcaatggggcatgcagcagatcgatgggctgaccaacactccccgctgggttgcccaggcggtggtgtatcagatcttccctgatcgttttcgttgtagtggccgtgtcttagctcatcagcatttggctttgcgctgctggggcagtgacccttctgagcagggttttcaggggggagatctctacggggtgatcgaggcccttgatcatctccaggcgcttggtatcagctgcctttacttgacacccgtctttagttctgccgctaatcatcgctatcacgcttatgactacttgcaggtggatccgcttctcggtggcaatgcagcgctagaggctttgattgaggcggtgcatcgccgcgggatgcgcatcattttggatggcgtgtttaatcactgtggtcgcgggttctgggcttttcatcatcttttggaaaatggtgaggcttcgccctatcgcgattggtttgaggtgcggcaatggccgcttcatccctatccacggcgtgggcaggattgtggttacagctgctggtggaacgatccagccttgccaaagttcaatcatgcccatgcccctgtgcgtgagtatttgattgccgtagcccgctattggctcgagcagggaatcgatggttggcgacttgacgttgctgatgaggtgcctgctgagttttggctggagtttcggcacatggttaaggcagtgaatccagacgcttggatcttggctgagatctggggtgatgcgagaccgtggctacaggggcagcactttgatggggtgatgaattatcggatgggttggagcagcctttgctgggttgctggtaagcgattacgccgtcggtatcgcaatcctgcctatccccttgaccctctgagtggggaggcttttgttgagctattggcaacaacgctgggttggtatcgacctgaggtgaaccgcagccagttgaacttgcttgatagccacgatgtgccgagagctttgcacacacttcagggggatcttgcggcgttgaagttggccttgctgttgttgtttttgcaaccaggggcgccttgcatctactacggcacagaggcgggtttgcagggtggccctgaaccaggttgccgagaagggttcccttggcatacgccttggcctgcagacctgcgcgatttcattcagtcgttgagtgatctgcgccaacgttgcccagcgttgagtgatggcggtttgcaatggcaaccgattggagctgatgcacttcatgcttggctgatgcagcccgagccaggcacaacacaaaaggagacgccgattcaggtgtgggtcaatcgcagtcgcaggtcatggttgcggatgaaaggctcatcgacagaccctctttggctggaaggagcattggaatgcaatggccggggattaggccctcaatcagcagtgttgtttcactga

SEQ ID NO: 722 - protein, 483 aa, Prochlorococcus marinus str. MIT 9313
MQWGMQQIDGLTNTPRWVAQAVVYQIFPDRFRCSGRVLAHQHLALRCWGSDPSEQGFQGGDLYGVIEALDHLQALGISCLYLTPVFSSAANHRYHAYDYLQVDPLLGGNAALEALIEAVHRRGMRIILDGVFNHCGRGFWAFHHLLENGEASPYRDWFEVRQWPLHPYPRRGQDCGYSCWWNDPALPKFNHAHAPVREYLIAVARYWLEQGIDGWRLDVADEVPAEFWLEFRHMVKAVNPDAWILAEIWGDARPWLQGQHFDGVMNYRMGWSSLCWVAGKRLRRRYRNPAYPLDPLSGEAFVELLATTLGWYRPEVNRSQLNLLDSHDVPRALHTLQGDLAALKLALLLLFLQPGAPCIYYGTEAGLQGGPEPGCREGFPWHTPWPADLRDFIQSLSDLRQRCPALSDGGLQWQPIGADALHAWLMQPEPGTTQKETPIQVWVNRSRRSWLRMKGSSTDPLWLEGALECNGRGLGPQSAVLFH

SEQ ID NO: 723 - DNA, 1407 bp, Synechococcus sp. WH 8102
  CDS (1)..(1407): transl_table=11
atggcgtcctccacgcccttccacgacccaccggcctgggtggcggatgccgtggtgtatcagatctttccggatcgattccgccgcagtggtcaggtgaaggctcagcaacatcttgagctgaagccctggggcagtgatccccgtgagcagggctttcaagggggggatctctacggggtgatcgaggcgttggatcagctgcaggccatgggcatcagctgcctgtacctcacgccgatcttcagctccgccgccaatcaccgctatcacgcctacgactatttcgaggtggatcccctgctgggggggaatgacgctctggatacgttgatcgcagccttacaccagcggggcatgcggctggtgctcgatggtgtgttcaaccactgcggccgtggcttctgggcctttcatcacctggtggaaaacggccaggactccccctaccgggattggttcaatgtgcaccgctggcctgtaaagccgtatccggccgagggcgaggactgcggctacgattgctggtgggctgtgcctgatctgcccaagttcaaccatgccaatcccgcagtgcgggaccatctgttggaggtgggtcgtttctggctggaacggggcatcgatggttggcgtctggatgtgcccgcggaagtgccagccgagttctgggtggatttccgtcgcgtggtgcgggaggtcaaccctgacgcctggatcgtgggtgagatctggggtgatgcccgggagtggctgcggggcgagcactttgatggggtgatgaattaccgcctcggctggagcagcctcggctgggtggcaggagatcggttgaggcagggataccgcaatccggagtacccactgaatcccctcagtagcgaggatttgatcgaaatctggagcaccacgtccggttggtaccgcccagccgtgaatcgagctcagatgaacctgctcgatagccacgatgttcctcgggcactccacagcctcgatggagatgtgaaggctctgaagctcgccctgctgctgatctttctgcagcaaggggccccatgcgtgtactacggcaccgaatctggattgtgcggtggcccggaacccgcctgtcgtgaagcctttccctggggtgaaccctggcctgcggatctgagctcaaccattgcggccttggctgatctccggcgaaatcaacccaatctcattcgcggcgatctgaagtgggagccgatcggacgcgacggactgctgggaagcacccctggcggtttaagcgtctgggttaaccgcagcaccacgacctcgctgcagattgatcctgggatttccagaatctggagttgtggcgcctgcgatggacaagctctagagccgcaatctgcagtggtgcatctgcagggataa

SEQ ID NO: 724 - protein, 468 aa, Synechococcus sp. WH 8102
MASSTPFHDPPAWVADAVVYQIFPDRFRRSGQVKAQQHLELKPWGSDPREQGFQGGDLYGVIEALDQLQAMGISCLYLTPIFSSAANHRYHAYDYFEVDPLLGGNDALDTLIAALHQRGMRLVLDGVFNHCGRGFWAFHHLVENGQDSPYRDWFNVHRWPVKPYPAEGEDCGYDCWWAVPDLPKFNHANPAVRDHLLEVGRFWLERGIDGWRLDVPAEVPAEFWVDFRRVVREVNPDAWIVGEIWGDAREWLRGEHFDGVMNYRLGWSSLGWVAGDRLRQGYRNPEYPLNPLSSEDLIEIWSTTSGWYRPAVNRAQMNLLDSHDVPRALHSLDGDVKALKLALLLIFLQQGAPCVYYGTESGLCGGPEPACREAFPWGEPWPADLSSTIAALADLRRNQPNLIRGDLKWEPIGRDGLLGSTPGGLSVWVNRSTTTSLQIDPGISRIWSCGACDGQALEPQSAVVHLQG

SEQ ID NO: 725 - DNA, 1443 bp, Gloeobacter violaceus PCC 7421
  CDS (1)..(1443): transl_table=11
atgcagattcacacaccgaactgggtaaagcacgctatcttctatcagatctttccggaccgcttctcccgcacccagcagttaaaacaaaagctgttgcaggcggtctccttcgaggattgggcagccgccccgaccctctacggctataaaggcggcgatctgtggggggtaatcgaaagactcgattacctgtcggatttgggcatcaacgccatctatttcactccgatatttcaatcggcgagtaaccaccgctaccatacccacgattactatagagtcgatccgctgctgggaggaaacgaggcgttcaaggcattgctcgatgccgcccacgcccgcgacatcaaagtggtgctcgacggtgtatttaaccacgcgagccgcggttttttcttcttccacgacatccttgaaaatggtcaactctccccgtggctcgactggttcaagatcgaaggctggcccctctcgccctacaatgtcgagcagcccgccaactatgcctgctgggacaacaaccgtgccctgccccagttcaaccatgccaatccgatggtgcgcgagtacattatggagattgccgaatactggatcaaagcgggtatcgacggctggcgcctcgatgtgcccgcctgtgtagaggcggaaggtttctggcaggaatttcgcgagcgcgtcaaggcaatcaatcctgaagcctacatcgtcggcgaaatctgggaggatgcccgccagtggctcgacggcacccagttcgacggggtgatgaattatctgtttgccgccccgaccatcgcctttacggccggggatcgcgtccaggtgcagtacgtgcaggaccgttcctacaggccctacccggcgctgttcgccgttgagtacaaagaggcaatcgacaaattgttggggctgtacgactgggagatccagctggcgcaactcaacttgctcgatagccacgacacggccagggtactgaccatcgccgggggcgaccgcgcgagtgtagaactggcgacactgctgttgctcacctttcccggggcgcccagcatctactacggcgacgaggtgggcctgcccggcggcatcgaccctgattcgcgccagggttttcctcccgaatcgcagtggaacggcgaactgctcgcgctgcaccgcgacttgatcgccctgcgccaccgccacgaagcgctgcgcatcggcaaatacaaaagcgtctatgcctccggccagtgctatgtcttcgagcgccgcctggaggcggaagtgctgttggtggccgtcaacgccgggaccgaaccggcgcgcgtcaccctcgaagcgcctggggaaacctacccgcgcaaagtgctcttcggtcccggccaggtggaagccgccgaagggcatctggaattgagcctgccggcccgcagcggtctggtgctggggtag

SEQ ID NO: 726 - protein, 480 aa, Gloeobacter violaceus PCC 7421
MQIHTPNWVKHAIFYQIFPDRFSRTQQLKQKLLQAVSFEDWAAAPTLYGYKGGDLWGVIERLDYLSDLGINAIYFTPIFQSASNHRYHTHDYYRVDPLLGGNEAFKALLDAAHARDIKVVLDGVFNHASRGFFFFHDILENGQLSPWLDWFKIEGWPLSPYNVEQPANYACWDNNRALPQFNHANPMVREYIMEIAEYWIKAGIDGWRLDVPACVEAEGFWQEFRERVKAINPEAYIVGEIWEDARQWLDGTQFDGVMNYLFAAPTIAFTAGDRVQVQYVQDRSYRPYPALFAVEYKEAIDKLLGLYDWEIQLAQLNLLDSHDTARVLTIAGGDRASVELATLLLLTFPGAPSIYYGDEVGLPGGIDPDSRQGFPPESQWNGELLALHRDLIALRHRHEALRIGKYKSVYASGQCYVFERRLEAEVLLVAVNAGTEPARVTLEAPGETYPRKVLFGPGQVEAAEGHLELSLPARSGLVLG

SEQ ID NO: 727 - DNA, 1935 bp, Vibrio vulnificus YJ016
  CDS (1)..(1935): transl_table=11
ttgaaaaataacgtgatttttatttctcaaggggggatgtcgctcagcgctgtgcttttagaatggtatgaaataccgattaaaagagtactcgcaatgaccctaccttttctttttcatgcgcaaacgccggattatttccgcgttgagaatcaaatcgctcacgttaccttaagaactcagcctgaaggaattcaagccgtctacctgcggcacgagcctgacaatgaagagtacttagtagaaatgcagcgagtctctaagttaggggaactcgatggctggcaagcgtcattccctttgaataaagaccgagagatcacccagtacgttttcaaagtgatcacagaaggtgccaccgtctggttagacgctcgtggcatacagaaacggatgccaggcagcgagtaccatttcaaatataaccaatctcatcagccgccagagtgggtgagtgagcagattttctaccaaattttccctgatcgattctgtaatggtaacccagagatcagcgttaaaagtggcgaatactcggtaaaaaatggcacacgccctgtggtcgcaaaagagtggggagcggccgttgacaaacacaatggctatgggggttgtgagttttatggcggggacttggctggcattcgcagcaaattggattacctgcaaaccttgggcgtgacagcgctctatctcaatccgattttttcggcgccgagcaatcacaaatacgacaccaccgattacttaaccattgatccgcatttgggaagcaaccaagagtttgcagagttgagcgaagcgcttcatcaacgcggtatgaaaattgtgcttgatgccgttttcaatcacacctcatgtgagcacccttggtttgataaaaatggggtaggtgagatgggggcttatcaccacatcgaatcgccgtatcgccattattattttttcgaagacggtagccaaaattatattggctggaagggcgttgacagtttaccagtactgaattttgaaaatgcggaggtacgtaattacatttatgccagcgaacacgcggccattcgccactggttgaaagcaccctatcgaatcgatggttggcgttttgacgtgatccacatgcttggagaaggtgaaggggcgagcaacaatgcctactatgttaagcagttccgcaatgcgactaaacaagaaaaccctcaagcttatgtattgggggagcatttctttgaggcgagcaagtggctccaaggtgagcaagaagatggctcgatgaattactacggctttgcgcatccagtgagagcattattggccaaaaaagacattgcctaccatcctattgagatcgactgcatcgactttgttgattggctaaatgaatcacgcgctaaagtaccttggcttaaccagctcagccagttcaatcaactcgacagccacgacaccgcacgttttattaccttgttggaaaatgaccaagcgcgcatgaacattgctctcggcttgctgttcacttatgtaggaaccccttgtatctattatggtagtgaagttggactggaaggtgagaatgacccagataaccgccgctgtttcccgtgggagcgtgttggtcatgtggagacgttccaatatcaccaacgtctaattgaacttcgcaaaacgtctaaggcgctgcagcaaggagcgatccaatttttgcatgttgaaccaacgtcgttcagttttgctcgtcagtatggtgaagacactctgcttgtgatggtcaacttagattcgaaggcatgctctatgacgctgccaatttggcaacttggaaagccgcaaggacgtctggtttccctattgggtaatgaaagtgctttgcaagtaaatagtaaagttgtggttaatatctcttctgaatccattcaaatttggaaacttgagtga

SEQ ID NO: 728 - protein, 644 aa, Vibrio vulnificus YJ016
MKNNVIFISQGGMSLSAVLLEWYEIPIKRVLAMTLPFLFHAQTPDYFRVENQIAHVTLRTQPEGIQAVYLRHEPDNEEYLVEMQRVSKLGELDGWQASFPLNKDREITQYVFKVITEGATVWLDARGIQKRMPGSEYHFKYNQSHQPPEWVSEQIFYQIFPDRFCNGNPEISVKSGEYSVKNGTRPVVAKEWGAAVDKHNGYGGCEFYGGDLAGIRSKLDYLQTLGVTALYLNPIFSAPSNHKYDTTDYLTIDPHLGSNQEFAELSEALHQRGMKIVLDAVFNHTSCEHPWFDKNGVGEMGAYHHIESPYRHYYFFEDGSQNYIGWKGVDSLPVLNFENAEVRNYIYASEHAAIRHWLKAPYRIDGWRFDVIHMLGEGEGASNNAYYVKQFRNATKQENPQAYVLGEHFFEASKWLQGEQEDGSMNYYGFAHPVRALLAKKDIAYHPIEIDCIDFVDWLNESRAKVPWLNQLSQFNQLDSHDTARFITLLENDQARMNIALGLLFTYVGTPCIYYGSEVGLEGENDPDNRRCFPWERVGHVETFQYHQRLIELRKTSKALQQGAIQFLHVEPTSFSFARQYGEDTLLVMVNLDSKACSMTLPIWQLGKPQGRLVSLLGNESALQVNSKVVVNISSESIQIWKLE

SEQ ID NO: 729 - DNA, 1725 bp, Lactobacillus johnsonii NCC 533
  CDS (1)..(1725): transl_table=11
atgcaacttgcagctttaaaacacagaactgaaagtgaaaattgttttgttattgatcattcacacgttaaaattagacttcatacggcaaaagatgatgtggaaaaagtaattgttcattacacggataactatctcccaccaaaacaagctaaagaacttgaaatggagaaaataggtagtggtcaagttaatgattactggggagcaaccttaactgctccatatcaccgaattaaatatacttttgaagtgataggcaaagacggaagtcatgtgatcttcggtgatcgtagtattgaaaaatttagcgataaaaagttaagagaagatggaatgtattttaaagttccgtacttccatgatattgatcgcatcaagactccaaaatggcttaaagatattgtttggtatcaaatttttccagagcgttttgctaatggcgataaaagtaatgacccagcaaatgttaaagaatggaatccagaagatcatccaggcagagaagatttttatggtggagacttacagggagttttagatcatctagatgatctacagaaattaggagttacgggattatatttctgcccaatttttaaggcaagttctaatcataaatatgacacaattgattatttacaagtagatccagcttttggagacaaggatttgtttgcaaaagtagttaatgaagcacataagcgtgggatgaaagtgatgcttgatgctgtatttaatcacttaggtgatcaatcaatgcagtggcaagatgtcgttaaaaatggcgaaaaatcacgttttaaagattggttccacattaattcatatcctgttgaaccatatcgggacccaagtaaaggtgaaaataatccaccatatgaaacttttgccttcgaaaaacatatgcctaagttaaatacggctaacccagaagtacaggactttttattagaaattgcgacctactgggtaaaatattttgatattgatgcttggcggctagatgttgcaaatgaagttgaccaccatttctggaagagattccatgatgaattagttaaaataaagcctgatttttatattgctggggaaatatggcattcagctcgtccatggcttcagggggatcaatttacaggtgtaatgaattatccatatactttacaaattgaagaccacttctttaaacataaaatggatgctaaagaccttagtgaacacctaactgatcagttaatgatgtatccagatatggttgaccaggctatgatgaatatgcttgattcccacgatacggctagaattttaactttagcaaaagacaatcaagatttagctttgcaagcagttgcgtatgaatttgttcaacctggagtgccatgtatttactatggaacagagatggggatgagcggtgataatgatccggattgtcgtaaaccaatggattggagtaagataaatggtccggtatggcaaagagttcatgaattagtgaaattcagactagatcatagtgataccttaaataaaggtactgttaagttaacggtaacagaaaaaggacttctaaaagttgaacgaacaggcaaagaaacaataaaggcctactataataccggtaaacataatgtaaaaattgataaaacagcagctcttagtcagaattataaagcgggagtgttagcgccaaatggctttttgattgaggttaaagcttaa

SEQ ID NO: 730 - protein, 574 aa, Lactobacillus johnsonii NCC 533
MQLAALKHRTESENCFVIDHSHVKIRLHTAKDDVEKVIVHYTDNYLPPKQAKELEMEKIGSGQVNDYWGATLTAPYHRIKYTFEVIGKDGSHVIFGDRSIEKFSDKKLREDGMYFKVPYFHDIDRIKTPKWLKDIVWYQIFPERFANGDKSNDPANVKEWNPEDHPGREDFYGGDLQGVLDHLDDLQKLGVTGLYFCPIFKASSNHKYDTIDYLQVDPAFGDKDLFAKVVNEAHKRGMKVMLDAVFNHLGDQSMQWQDVVKNGEKSRFKDWFHINSYPVEPYRDPSKGENNPPYETFAFEKHMPKLNTANPEVQDFLLEIATYWVKYFDIDAWRLDVANEVDHHFWKRFHDELVKIKPDFYIAGEIWHSARPWLQGDQFTGVMNYPYTLQIEDHFFKHKMDAKDLSEHLTDQLMMYPDMVDQAMMNMLDSHDTARILTLAKDNQDLALQAVAYEFVQPGVPCIYYGTEMGMSGDNDPDCRKPMDWSKINGPVWQRVHELVKFRLDHSDTLNKGTVKLTVTEKGLLKVERTGKETIKAYYNTGKHNVKIDKTAALSQNYKAGVLAPNGFLIEVKA

SEQ ID NO: 731 - DNA, 1761 bp, Bacillus thuringiensis serovar konkukian str. 97-27
  CDS (1)..(1761): transl_table=11
atgcttaaagaagccatttatcataggccaaaagataattacgcatacgcttatgatgaaaaaacgattcacatccgaatacgtacgaaaagagacgatgttcaaagcaccactcttatttatggtgatccttatgaatggaaagacgggaagtggatttcttcaagtacaccgatgaaaaaaactggttctactgcattgtttgattattggttcatttccatcgagccgaaatttaagcgcttacgttatggatttgaattaaaaaacgatacagacactcttatttatgcagagcgaggatttttttctaccactccaaatgatgacgttggtaactttttctgttttccatttattcatgcaaatgatgtattcaaagcaccttcttggattaaagatactgtttggtatcaaattttcccagaacggttcgctaatggagatcatacgctgaatccagaaaacacccttccttggggcagcgctgagccaactccaactaattttttcggtggagattttgctggtattattcaaaaccttgattaccttgttaagctcggaatttctggaatatatttcacacctattttcaaagcacattcaaaccataaatatgacacaattaactacatggaaatcgatccgcaatttggcacaaaagaaacattcaaagaactcgttcaggcatgtcatacacatggtataaaggtaatgctcgatgccgtattcaatcacagtggatactttttcgataaatttcaagacgtactacaaaatggtgagcagtcagcatataaagaatggttccatattcatgagttcccaattagaactgagccactcccgaattatgatactttcgcgtttacaccatatatgccaaagttaaacacagcgcacccggatgtaaaagaatacttacttgaagtagggcgttattgggtgagagaattcaatatagacggttggcgccttgatgtagcaaatgaagtcgaccataacttttggagagaatttcgaagtgagataaaagcattaaattctgaagtatatattttaggagaaatttggcacgatgcacttccatggctacaaggagatcaattcgatgctgtcatgagctatcctgttacaaacgccctactgtcttactttgctaacgattccattaaggcaaatgaatttatgaaacaaattacagaatctctacattcctactctatgaatgtaaatgaagcagcatttcatttattagatagccatgatacaccaagaattttgacaacatgtaacggagataaaaataagttaaaattactttatgtattccatctttctttcatcggctctccttgtatttattatggagacgaaattggtatggacggcggtatggatccagattgtcgcaaatgtatggtttgggatacggaagaacaagatcatacattatttacacatgtacaaacattaatttcattacgaaagcaatataaagcatttggaggacatggtactttccaattcattgaagcaaatgatgaatataattatatttcttatacgaaaacatatgaagatgaaacgatctttttcgttttaaatccgactaatagtgatattacagcttcactccctctccatgttactggaaagaaaatcattaatatttatacaaacgaagaattttcagcggaagcaagtgtattacaagttacacttcctccatatggattctccatattaaaatggtaa

SEQ ID NO: 732 - protein, 586 aa, Bacillus thuringiensis serovar konkukian str. 97-27
MLKEAIYHRPKDNYAYAYDEKTIHIRIRTKRDDVQSTTLIYGDPYEWKDGKWISSSTPMKKTGSTALFDYWFISIEPKFKRLRYGFELKNDTDTLIYAERGFFSTTPNDDVGNFFCFPFIHANDVFKAPSWIKDTVWYQIFPERFANGDHTLNPENTLPWGSAEPTPTNFFGGDFAGIIQNLDYLVKLGISGIYFTPIFKAHSNHKYDTINYMEIDPQFGTKETFKELVQACHTHGIKVMLDAVFNHSGYFFDKFQDVLQNGEQSAYKEWFHIHEFPIRTEPLPNYDTFAFTPYMPKLNTAHPDVKEYLLEVGRYWVREFNIDGWRLDVANEVDHNFWREFRSEIKALNSEVYILGEIWHDALPWLQGDQFDAVMSYPVTNALLSYFANDSIKANEFMKQITESLHSYSMNVNEAAFHLLDSHDTPRILTTCNGDKNKLKLLYVFHLSFIGSPCIYYGDEIGMDGGMDPDCRKCMVWDTEEQDHTLFTHVQTLISLRKQYKAFGGHGTFQFIEANDEYNYISYTKTYEDETIFFVLNPTNSDITASLPLHVTGKKIINIYTNEEFSAEASVLQVTLPPYGFSILKW

SEQ ID NO: 733 - DNA, 1830 bp, Yersinia pseudotuberculosis IP 32953
  CDS (1)..(1830): transl_table=11
atgcttagtggttggcaccttccggtctcgccttttgttcgtttggcagacgacgcattacatatcacgctctggttgcaaggtgatagtttacctgcgcaagtctttctgcgttgtgagccagataatgaagagtggctgctcactatggaggggcatgagagccatgatcgttggcgctatagcgtttctttaccgttatatgaggggcagccaacccggcgctactgcttcaaactattatgggatgaccaccaacagtggtttggcccgttggggttctcggtgattcctccagcacagttggcacagtttgctgtagatgtacccgatagcgggcctgattgggtcgcggaccaagttttttatcagatcttccccgatcgctttgccagtagtcaggcagatcatggtgtgcaggaggggagttatattcatcatgcggccggttgcccggtatctcgccgcgagtggcagcagccattggatgatgtgcatgccgcatcgacattttatggtggcgatctggccggtattagtcagaaaatcccttactttcaacaactgggggttacggcgctgtatttgaaccccatttttaccgctcccagtgtgcataaatatgatactgaagattattatcaggttgatccctacttggggggagagcgtgatttcttgcaattgcgagccgccacccgtgaagtaggaataaagttggtgctcgatggcgtgtttaaccacacgggtgattctcatcgctggtttgatcgctatcaacaaggggaaaatggcgcctgccatcacgaagattcgccttatcgtggttggtttacgttcctccctgatggacgagcattagattggaaaggtaatgccagtttgccaaaacttaattttgccaatgaagaggtcgctgaacgaatctatcgcagtgatgacagcgtcgtgcgttattggttacggccaccatacagtattgatggctggcgtctggatgtcgtacacatgctcggggaagatggcggcgctaaagggaatttgcaccatctgcacggtatctatcaggcagcaaaagaagaaaatccgcaggcttatattctgggcgaacattttggcgatgcacgtaattggttgcacgctggagtggaagacgcggcaatgaattatatgggttttgctttgccggtccgcagttttctcgccgagctagatgtggcttgccatcctataaaattggatgctgcggattgcgcctactggatggatgagtaccgcgcaggattgccccatagccagcaactccgtttatttaatcaattagatagccatgatactgcccgttttcttaccttattaaagggtgataaaacccgtatgcaaatggcgctaatatggttgtttagttggattggtgtgccttgcctattttatggtgatgagattgggctggatggcgggaatgatccgttctgccgcaaaccgttcccgtgggatgaggctcagtgggatcatgacctattatcactgtgtcaacgtatggcggctttacgccacaaaagcatagcgttgcggcgcggggggtgtcaggtgatccatgccagtggtgattccctggtctttattcgtagctatcaaactgagcgtgtgatggtggcgatacaacgttccgatgatgcggatattttcctgcccgcctctcctttactcaatgtggctgagtggcagcgtctggaaggtggaggagacctggctgtcagtgagactggcgtaaacatggggctggagggtaagagtgttaccttgtggtgtggtgttggtgagtgctaa

SEQ ID NO: 734 - protein, 609 aa, Yersinia pseudotuberculosis IP 32953
MLSGWHLPVSPFVRLADDALHITLWLQGDSLPAQVFLRCEPDNEEWLLTMEGHESHDRWRYSVSLPLYEGQPTRRYCFKLLWDDHQQWFGPLGFSVIPPAQLAQFAVDVPDSGPDWVADQVFYQIFPDRFASSQADHGVQEGSYIHHAAGCPVSRREWQQPLDDVHAASTFYGGDLAGISQKIPYFQQLGVTALYLNPIFTAPSVHKYDTEDYYQVDPYLGGERDFLQLRAATREVGIKLVLDGVFNHTGDSHRWFDRYQQGENGACHHEDSPYRGWFTFLPDGRALDWKGNASLPKLNFANEEVAERIYRSDDSVVRYWLRPPYSIDGWRLDVVHMLGEDGGAKGNLHHLHGIYQAAKEENPQAYILGEHFGDARNWLHAGVEDAAMNYMGFALPVRSFLAELDVACHPIKLDAADCAYWMDEYRAGLPHSQQLRLFNQLDSHDTARFLTLLKGDKTRMQMALIWLFSWIGVPCLFYGDEIGLDGGNDPFCRKPFPWDEAQWDHDLLSLCQRMAALRHKSIALRRGGCQVIHASGDSLVFIRSYQTERVMVAIQRSDDADIFLPASPLLNVAEWQRLEGGGDLAVSETGVNMGLEGKSVTLWCGVGEC

SEQ ID NO: 735 - DNA, 1764 bp, Bacillus licheniformis ATCC 14580
  CDS (1)..(1764): transl_table=11
atgatggaatatgcagcgatacatcatcagcctttcagctctgatgcctattcttacaatggacggacattgcacatcaagatccgtacaaaaaaggatgatgccgaacacgtccgcttggtttggggcgatccttacgaatacaccggcggcacatggaaagcgaacgagcttgcgatggcgaaaattgccgcaacaagcacccatgattactggtttgccgaagtggcgcctccattcaggcgtctgcaatacggatttatcctgacaggcgctgatgatcgagacactttttacggaagcaatggtgcatgtccgtttgccgggaaagcggcggatataggcaaacactgttttaaatttccgtttgttcatgaggcagacacgtttgatgcacctgactgggtcaaatcaaccgtctggtatcaaatttttccggagcgctttgccagcgggcgggaagatttgtctccggaaaacgctttgccatggggaagcaaagatcctgaggcgcacgattttttcggaggggatttgcaggggatcatggacaagctggactatttggaagacttgggggtaggcggaatctatttgacgccgatctttgccgcgccttccaaccataaatacgacacattggactattgctccatcgatccgcattttggcgatgaggagctctttcgcacgctggtcagccggattcacgagcggggaatgaaaatcatgcttgatgctgtttttaaccacattggcagcgcttcgcaagagtggcaggatgttgtcaaaaacggtgaaacgtcccgctataaagactggttccatattcattctttccctgttaaagaaggcagctatgatacatttgcgtttactcccgagatgccgaagctcaatacggccaacccggaagttcaggcttatttgcttgatattgcgctgtactggatccgcgaatttgatatcgacggctggcgtttggatgtggcaaatgaagttgatcatgcgttttggaagaaattccggcaagccgtcacggcagaaaagcccgacatttttatattgggcgaaatctggcatcaggctgatccgtggcttagaggagacgaatttcattcggtcatgaactacccgttcacagaaccgatgattgactattttgcagacggatcgatttcagcttcgcaaatggccagccgcatcaattcgcatttaatgagcgggatgaagcaggtcaatgaggtgatgtttaatttgctggacagtcatgacacgaagcggattttgacaagatgcggaggagatgacaaaaaggtgcgctctcttttggcattcatgtttgctcagacaggctcgccgtgcatttattacggaacggaagtcgggcttgacggcggcgatgatccattgtgccggaagtgcatggtttgggaagaggaaaaacagaatcaagagatgctcgcatttatgaaacggctgatcgctttgcgaaaacaagagaatgatgtattgacttatggcgcgcttgagtggaagctggttgatgaccaaaacgattttgtcagtttttctcgaacgcatgaaggaaaagagctgatctacttcttccaccagggcagcgaggtgcgccgtgtcagattgcgggatttgaagattgcaagcgataaaagaatatacgatgcgtggacggaagaagcgcttcagcatgatgatgtggtcgacattcagccaggcggatttttcattttgggggcggtctaa

SEQ ID NO: 736 - protein, 587 aa, Bacillus licheniformis ATCC 14580
MMEYAAIHHQPFSSDAYSYNGRTLHIKIRTKKDDAEHVRLVWGDPYEYTGGTWKANELAMAKIAATSTHDYWFAEVAPPFRRLQYGFILTGADDRDTFYGSNGACPFAGKAADIGKHCFKFPFVHEADTFDAPDWVKSTVWYQIFPERFASGREDLSPENALPWGSKDPEAHDFFGGDLQGIMDKLDYLEDLGVGGIYLTPIFAAPSNHKYDTLDYCSIDPHFGDEELFRTLVSRIHERGMKIMLDAVFNHIGSASQEWQDVVKNGETSRYKDWFHIHSFPVKEGSYDTFAFTPEMPKLNTANPEVQAYLLDIALYWIREFDIDGWRLDVANEVDHAFWKKFRQAVTAEKPDIFILGEIWHQADPWLRGDEFHSVMNYPFTEPMIDYFADGSISASQMASRINSHLMSGMKQVNEVMFNLLDSHDTKRILTRCGGDDKKVRSLLAFMFAQTGSPCIYYGTEVGLDGGDDPLCRKCMVWEEEKQNQEMLAFMKRLIALRKQENDVLTYGALEWKLVDDQNDFVSFSRTHEGKELIYFFHQGSEVRRVRLRDLKIASDKRIYDAWTEEALQHDDVVDIQPGGFFILGAV

SEQ ID NO: 737 - DNA, 1866 bp, Photobacterium profundum SS9
  CDS (1)..(1866): transl_table=11
atgaaaacgccatttctttaccatggacaggatagcgcctggcttactcctacagacaacacgcttaacgtaacaatggtcagtgatgttgatacactgatatcagctatctttattcgatgtgaacccgataatgaagaactattaattgatatggaacgcggtagaacccaaggtcgcctgcaatactggcacgggaaattaccgttcaattcagataaagacaccactttttatacctttaaagtgatgcaaaacagtcgtcaatggtggctacacggttgtggcgtgtcaccgcgagtaccgggtaaagaaaagcacttcaaattcaataaccagcatcaaccgccagcttgggttaaagaacagattttctatcaagttttcccagaccgtttttcaaatgcaaacccatcaatcagtgttcaatctaatgaatactgtttacgtggcacagaaaaaccgacaatagcaaaagcatggggtgaatcagcatcaaaccatgattcgagtggaccaagcgaattcttcggaggcgacttacaaggtattcacaataagattgattacttacaagaattaggtgtaaccgcactctatttgaatccgatatttaccgcgcccagtaatcataaatacgatacaacggattacctcaatatcgatcctcatttaggcacgaatgagcaatttgccaacatggtggcagatctgcatcaacgtaatatgaagattatgctagatgccgtgtataaccatacctcagtcgaccacccttggttcgatatgtatcaacgtaataccgcagaccaagctgtgggcgcatacgatcatcctaactctacttaccgtcagtattatcaatttaccgataacagtaacgaatacgttggctggaatggtatatcaacgctacctaaactgaatttttctaatcctgaagtacaggattatatctatgcgggtgacgacgcggtaatcaaacactggctaaaaccaccctataatatagatgcatggcgtttcgatgttatccatatgctaggtgaaggcaaaggcgcacgtaataatgctcattttgttaaatccttccgcaatgcagccaagtcggtcaatcctgagtgctatgtgttaggcgaacatttctttgaagcgtctaactggcttcaaggtgatcaagaagacggtgctatgaactattacggttttgctcaccctcttcgtgcttttttttctcaaaaagacattgcctatcacgcatgccaaatcaatgctgtagaattagtagaatggctaaacgaagcgcgtacaaaattaccgtggttgaatcagctctctcagcttaaccagctagatagccacgatacaatgcgttttttaaccatggtggataacaacacagaaacgatgcacctagcattaatgatgctttttgcttatgtaggcacaccgtgtgtttactacggtacagaagttgaattacaaggcggtcaagatccagataaccgtcgttgtttcccgtgggaaagaacagagcaagaacaaaaaccacaaacattcagttatttgcagcaactcattgctgtcagaaaatcatcaaccgcccttcaatccggcagtgttcagtggttattggctgagaaccaatattttgcttttgctagaacgacagaaacagagcatgttatttgccttattaataacagtgaatcagctaaaacacttcatttaccggtttggcaattaggcattgagtcgggttctttacgcgacctgttaactgatgatgaatggcatattagcgaaggaagtgtatctgtcacattggcaggcaaagaaggaatattactgactgtcagcgaataa

SEQ ID NO: 738 - protein, 621 aa, Photobacterium profundum SS9
MKTPFLYHGQDSAWLTPTDNTLNVTMVSDVDTLISAIFIRCEPDNEELLIDMERGRTQGRLQYWHGKLPFNSDKDTTFYTFKVMQNSRQWWLHGCGVSPRVPGKEKHFKFNNQHQPPAWVKEQIFYQVFPDRFSNANPSISVQSNEYCLRGTEKPTIAKAWGESASNHDSSGPSEFFGGDLQGIHNKIDYLQELGVTALYLNPIFTAPSNHKYDTTDYLNIDPHLGTNEQFANMVADLHQRNMKIMLDAVYNHTSVDHPWFDMYQRNTADQAVGAYDHPNSTYRQYYQFTDNSNEYVGWNGISTLPKLNFSNPEVQDYIYAGDDAVIKHWLKPPYNIDAWRFDVIHMLGEGKGARNNAHFVKSFRNAAKSVNPECYVLGEHFFEASNWLQGDQEDGAMNYYGFAHPLRAFFSQKDIAYHACQINAVELVEWLNEARTKLPWLNQLSQLNQLDSHDTMRFLTMVDNNTETMHLALMMLFAYVGTPCVYYGTEVELQGGQDPDNRRCFPWERTEQEQKPQTFSYLQQLIAVRKSSTALQSGSVQWLLAENQYFAFARTTETEHVICLINNSESAKTLHLPVWQLGIESGSLRDLLTDDEWHISEGSVSVTLAGKEGILLTVSE

SEQ ID NO: 739 - DNA, 1656 bp, Thermus thermophilus HB8
  CDS (1)..(1656): transl_table=11
gtggagcttttcctggaaaccgaggcgcgggaaggggttctcctttacgagcgggacggggagttgcagaaaaagcccatggcgccttgggagcggggcctaaaggcgcgggtgcccgtccacgcgagccccttccgctactgcttccgcctcccccaaggctacctgggcagccacggcctggagaggaccctgccccgctacgaccgcttcttccacctcctcgccaagccccttcccccggagtgggccctgggggcggtcttctaccagatctttcccgaccgcttccgccaagggcgcccggagcttgcccccaaggagggggcctggctttacggggggaggcccatccgcaagaaggcctggcacgagccccccggggaggacggggcccgggagttctacgggggggacctctttggggtcctcgaggccctcccctacctggaggccctgggggtggaggccctctacctcacccccatcttccaaagcccctccagccaccgctacgacaccgaggactaccaccgggtggaccctcatctaggcggggaggaggcgcttagggcgctttacgaggccctcgaggcccgggggatgaagctcatcctggacggggtcttcaaccacgtgggggcgacccacccctggttccagaaggcccttgaggacccctcctcccccgagcgggggatgttcaccttttatccggacgggagctacgccagcttctggggcgtgaagcacatgcccaagctggactacgcttccgccctcacccaggagcgcttcgtcttcggaaaggaggcccccgtccgctactggatgcgcctcgcccatggctggcggctggacgtggcccactccatcggggaaggggggacgaaccggaagaacgcccgctggctcagggccctggcccgggccgccaaggaggagcgggaggacgccctcgtcttcggggagctctcctacgacaccgtccccacgctgagggcccacaccctggacggggccatgcactacgccggcttcgcccacccggtgatggagtggctctcggggcgggacctccacggaaaccccgtggagctggaggccgaggacctttggcgggccctctttgaccactacgccgcccttcccctccagctccgccacgcgatgtacaccctcctctcctcccacgacatcccccgggccctctggcgcctcaggggggacaaggagcgcttcaagaccgcctacgccctcctctttgccttccccggaagccccgccgtctactacggggacgaggtgggcctctcccagcccaacccctacgaggtctggcggggagacccctactgccgcgcccccttcccctgggacgaggccctttgggacaaggacctcctcgccttcctccggcgcctcatcctcctcaagaagacccaccccgccttgaggctcggggggctcctccccctcaaggcccctccgggggtcctggccttcaggcggcgccaccgggggagggaggtctgggcctttttcgccaaggaagaggtgcgcctttcccttccccggggggtggacctcctttcgggaagggaggtggcgggggaggtggaggcgcggtacctcctcctggagcctttagaatga

SEQ ID NO: 740 - protein, 551 aa, Thermus thermophilus HB8
MELFLETEAREGVLLYERDGELQKKPMAPWERGLKARVPVHASPFRYCFRLPQGYLGSHGLERTLPRYDRFFHLLAKPLPPEWALGAVFYQIFPDRFRQGRPELAPKEGAWLYGGRPIRKKAWHEPPGEDGAREFYGGDLFGVLEALPYLEALGVEALYLTPIFQSPSSHRYDTEDYHRVDPHLGGEEALRALYEALEARGMKLILDGVFNHVGATHPWFQKALEDPSSPERGMFTFYPDGSYASFWGVKHMPKLDYASALTQERFVFGKEAPVRYWMRLAHGWRLDVAHSIGEGGTNRKNARWLRALARAAKEEREDALVFGELSYDTVPTLRAHTLDGAMHYAGFAHPVMEWLSGRDLHGNPVELEAEDLWRALFDHYAALPLQLRHAMYTLLSSHDIPRALWRLRGDKERFKTAYALLFAFPGSPAVYYGDEVGLSQPNPYEVWRGDPYCRAPFPWDEALWDKDLLAFLRRLILLKKTHPALRLGGLLPLKAPPGVLAFRRRHRGREVWAFFAKEEVRLSLPRGVDLLSGREVAGEVEARYLLLEPLE

SEQ ID NO: 741 - DNA, 1767 bp, Geobacillus kaustophilus HTA426
  CDS (1)..(1767): transl_table=11
atgaggaaagaagccatccaccaccgctcaaccgaccatttcgcttatgcttatgacagcgagacgctccatctccggcttcaaacaaagaaacatgatgtcgaccacgtcgagctgctttttggcgacccgtacgaatggcacgatggcgcctggcagtttcaaacgatgccgatgcggaaaacgggaagcgacgggttgtttgactattggctcgccgaagtcaaaccgccatatcgacggctgcgctatgggtttgtgcttcgagctgggggcgagaaactggtctatacggaaaaaggattttaccatgaagctccgagcgacgacaccgcttactacttttgcttcccctttcttcatcgggtcgacctattccaagcgccgggctgggtaaaagacacagtatggtatcaaattttccccgagcggttcgccaacggcaacccggccatcagtccgaaaggggcgcggccgtggggaagcgaggacccgacgccgacgagctttttcggcggcgacttgcaaggaatcatcgatcaccttgactatttggctgatctcggtattaccggcatttacttgacgccgattttccgcgcaccgtccaatcataaatacgacaccgctgattattttgaaatcgacccgcactttggggacaaagagacattgaaaacacttgtcaaacgctgccatgaaaaaggaatccgcgtcatgctcgatgcggtcttcaatcattgcggctatgagtttggcccgtttcaagatgtgttaaaaaacggcgcagcgtctaggtataaagattggttccatattcgcgagtttccgctccaaacggagccgcgcccgaattacgacacgtttgcgttcgtgccgcaaatgcccaagctcaacaccgcccatccggaagtgaagcgctacttgcttgatgtcgcgacgtactggattcgcgagtttgatattgacggctggcggctcgatgtggcaaacgaaatcgatcaccaattttggcgcgaattccgtcaggcggtgaaggcgctaaagcccgatgtgtacattctcggcgagatttggcatgatgccatgccttggctgcgcggcgaccagtttgacgccgtcatgaactacccgttggcggacgcggcgctccgctttttcgcgaaagaggaaatcagcgcccgccagtttgccgatatcatgatccgacttcttcattcgtatccgaaacaggtgaacgaagcggcattcaacttgcttggcagccatgatacaccaaggctgctcactgtttgcggcggcgacgtccgcaaagtgaagttgttgtttttgttccagctcacgttcactggttcgccgtgtatttactatggcgatgagatcggcatgacgggtggaaacgatccggaatgccggaaatgtatggtgtgggatccggagcaccaaaaccgcgaactgttggcgcatgtcaagcggctgattgcgctaaggaagcagcaccgggcgctccggcgcggagatgtctcctttctttccgccgacgacaaccctaaccatctcgtgtatgaaaaaattgacggcgctgaaaccgtgctcgtcatcatcaaccgaagcaatgatgccgccgacattccgctcccgctcgaccttcgcggaaaatggcttgttgacctcttgaccggagagcggtttgcggccgaggcggaaacgctttgcgcctctttgcctccgtatgggtttgtgctctataaagttgaaagctggtaa

SEQ ID NO: 742 - protein, 588 aa, Geobacillus kaustophilus HTA426
MRKEAIHHRSTDHFAYAYDSETLHLRLQTKKHDVDHVELLFGDPYEWHDGAWQFQTMPMRKTGSDGLFDYWLAEVKPPYRRLRYGFVLRAGGEKLVYTEKGFYHEAPSDDTAYYFCFPFLHRVDLFQAPGWVKDTVWYQIFPERFANGNPAISPKGARPWGSEDPTPTSFFGGDLQGIIDHLDYLADLGITGIYLTPIFRAPSNHKYDTADYFEIDPHFGDKETLKTLVKRCHEKGIRVMLDAVFNHCGYEFGPFQDVLKNGAASRYKDWFHIREFPLQTEPRPNYDTFAFVPQMPKLNTAHPEVKRYLLDVATYWIREFDIDGWRLDVANEIDHQFWREFRQAVKALKPDVYILGEIWHDAMPWLRGDQFDAVMNYPLADAALRFFAKEEISARQFADIMIRLLHSYPKQVNEAAFNLLGSHDTPRLLTVCGGDVRKVKLLFLFQLTFTGSPCIYYGDEIGMTGGNDPECRKCMVWDPEHQNRELLAHVKRLIALRKQHRALRRGDVSFLSADDNPNHLVYEKIDGAETVLVIINRSNDAADIPLPLDLRGKWLVDLLTGERFAAEAETLCASLPPYGFVLYKVESW

SEQ ID NO: 743 - DNA, 1770 bp, Bacillus clausii KSM-K16
  CDS (1)..(1770): transl_table=11
atgaaagtagcgatctaccatcgcccgaaaagtgaagatgcctacgcgtatgacaaagatacgatccacattcgtctgcgcacgcgcaaagacgatgctcacgaggtcatgcttatttatggagatccttacgattgggcgggaaacgaatgggtgactgccaaaaaaacaatgacacaagcaggggccgatggagaatatgattattggtttgtggaagtgaagccgccctaccatcgccttcgttacgggttcgaaattaaggcaaaagatgagacgatttactatggagaaagtgggttttgcgatacgcctgcaaaagacattagcgattatttctgttttccgtttatgaatcaagccgatttgtttacaccgcctgaatgggttaaagaaacgatctggtatcaaatctttcctgaacgttttgccaatggcgatcattcccgtgaccctgaaaatacattggcttggggaagtgcaccaccgactgcaaccaattatttcggcggtgaccttcaagggattgtcgatcatcttgattatttgcagaagctaggaattaacggcatttatttaacaccaatctttaaagcgttttccaaccataaatacgatacgattgattatttaaaagtagatccccaatttggagatgaaacgacacttaaactgcttgtcgatgaatgccataagcgcggcattcgtgtcatgcttgatgccgtcttcaaccatgcaggcctgtattttccaccttttcaagatgtactaaaacaccagcaggaatcagaatatagggattggtttcatatccgccaatttcctgttcgagcagaggaaccacctaattacgatacgttcgccttcacgcctttaatgccgaaactaaatacagcaaatgaagcagtaaaggactatttattgaacgtagctacgtattggattaaggagtttgacattgacggttggcgtttagatgtcgccaatgaagtcgaccatgccttctggcgtgagtttcgcaacagagtcaaagcattaaaaccagatttgtatattctcggtgaaatatggcataacgcttacccttggctgcaaggcgaccaattcgatggggtcatgaactacccgctcactgacgcgatttttgactttgtccaacacggcaaaagcgcaaccacttttcaatacgcggtcacaaaacatttgtacagttacccaaaattggtgaacgaagtccagttcaatttgctcggcagccatgacacaccaagaattttaactgtaagtgggggcaacaaaaaattagtcaaactttcctacttattgctgttttcctttcctggctcaccttgtatttattacggggatgaaatcggcatggccggagaaaatgaccctggttgccgcgcgtgcatggtgtgggaggaagaccaacaagatcaggagctattccaatttctgcaaaaactaattaagatccgcaaaactcaccaagcaatgggcacctataacaccttaaaattttatgactctggcactgaggatgtgctgttgtattccacatccgctggcggagagcttcttttatttgcggttaaccgcagtaaacaagaagcaacggtcaaactccctgattcactaaagagccttgcatttgtcgatgtcatttgcgaaagcccattgcaaagcgaagagctccacgttgaaggcgagtgctttttgttccttcattctgtcgacgccaacaaatgcggccaagtagacaagtaa

SEQ ID NO: 744 - protein, 589 aa, Bacillus clausii KSM-K16
MKVAIYHRPKSEDAYAYDKDTIHIRLRTRKDDAHEVMLIYGDPYDWAGNEWVTAKKTMTQAGADGEYDYWFVEVKPPYHRLRYGFEIKAKDETIYYGESGFCDTPAKDISDYFCFPFMNQADLFTPPEWVKETIWYQIFPERFANGDHSRDPENTLAWGSAPPTATNYFGGDLQGIVDHLDYLQKLGINGIYLTPIFKAFSNHKYDTIDYLKVDPQFGDETTLKLLVDECHKRGIRVMLDAVFNHAGLYFPPFQDVLKHQQESEYRDWFHIRQFPVRAEEPPNYDTFAFTPLMPKLNTANEAVKDYLLNVATYWIKEFDIDGWRLDVANEVDHAFWREFRNRVKALKPDLYILGEIWHNAYPWLQGDQFDGVMNYPLTDAIFDFVQHGKSATTFQYAVTKHLYSYPKLVNEVQFNLLGSHDTPRILTVSGGNKKLVKLSYLLLFSFPGSPCIYYGDEIGMAGENDPGCRACMVWEEDQQDQELFQFLQKLIKIRKTHQAMGTYNTLKFYDSGTEDVLLYSTSAGGELLLFAVNRSKQEATVKLPDSLKSLAFVDVICESPLQSEELHVEGECFLFLHSVDANKCGQVDK

SEQ ID NO: 745 - DNA, 1467 bp, Nostoc punctiforme PCC 73102
  CDS (1)..(1467)
atgcaaattcaaacaccagattgggtaaagcacgctgttttctaccaaattttcccagatcgctttgccagaagcaaacagccgcgcaaacggttattgcaagaagcccgttgggaagattgggactctatgccaaccctccagggttataaaggtggggatttatggggcatcatggaggatttagactacatccagaatttggggattaacgcgatttatttcacacccatctttcaatccgccagtaatcaccgctatcatacccacgattattatcaagttgacccgatgttagggggcaacgaggcttttaaagaattgcttgatgcagcccatcaacggaatatcaaagtcgttctggatggggtgtttaaccattccagccgtggctttttctttttccacgacgttttagaaaatggcccccattcaccttgggtaaattggttcaaaatagaaggctggcccctttcaccttataacggtgaattccctgcaaactacgtgggttgggcgggaaatcgcgccttgccagaatttaaccacgataatccagaagtacgagaatatattatggaaattgccgaatattggcttaaattcggcatcgacggttggcgattagatgtcccatttgaaataaaaactccgggtttttggcaggaattccgcgatcgcactaaagccatcaatcccgaagcatatattgtgggcgaagtgtggggagattcccgccagtggttggatggaacgcaatttgacggcgtaatgaattatttatttgctgggccgacaattgcttttgcagctggcgatcgcgtagtcttagaacaagtccaaagccgcgactatcaaccctacccacccttatttgctgccgagtacgccaccaaaatccaagaagtactgcaactttacccttgggaaattcagctaactcaactcaatttgttagcaagtcacgatacagcccgattgatgaccattgcaggcggtgatatagcgagtgtagaattatcgactttactgttactcacctttcccggtgcccccagcatttactatggtgatgaagtcggtttacctggtggcatagatcccgactcaaggcgtggctttcctttagaggctaactggaatcaagaaattttcaatactcatcgtcaattaattaccatccgccaaacatacccagccttgcgtacaggtgattaccaagtcctctatgctcaagggcaactttatctctttgcacgaactttaggcacagaagaattgataattgctataaacgctggcacaagttcggcaaccgcaaatgtagatgtggctagtttgcatactcaacccaacaagctgttatatggtactgctgaagctgagtggaatggtgaagaaggaactcagcaattgtcattaactcttcccgcacgcagtggctgcatcctggggactggggactag

SEQ ID NO: 746 - protein, 488 aa, Nostoc punctiforme PCC 73102
MQIQTPDWVKHAVFYQIFPDRFARSKQPRKRLLQEARWEDWDSMPTLQGYKGGDLWGIMEDLDYIQNLGINAIYFTPIFQSASNHRYHTHDYYQVDPMLGGNEAFKELLDAAHQRNIKVVLDGVFNHSSRGFFFFHDVLENGPHSPWVNWFKIEGWPLSPYNGEFPANYVGWAGNRALPEFNHDNPEVREYIMEIAEYWLKFGIDGWRLDVPFEIKTPGFWQEFRDRTKAINPEAYIVGEVWGDSRQWLDGTQFDGVMNYLFAGPTIAFAAGDRVVLEQVQSRDYQPYPPLFAAEYATKIQEVLQLYPWEIQLTQLNLLASHDTARLMTIAGGDIASVELSTLLLLTFPGAPSIYYGDEVGLPGGIDPDSRRGFPLEANWNQEIFNTHRQLITIRQTYPALRTGDYQVLYAQGQLYLFARTLGTEELIIAINAGTSSATANVDVASLHTQPNKLLYGTAEAEWNGEEGTQQLSLTLPARSGCILGTGD

SEQ ID NO: 747 - DNA, 1467 bp, Anabaena variabilis ATCC 29413
  CDS (1)..(1467)
atgcaaattcaaacaccagactgggtgaaaaacgctgtattctaccaaatctttccagaccgttttgctataagtaaacagtcccggaagcggctgttgcgtgatgtgcgttgggaagactgggacgcaatgccaacactgcaaggatacaaaggcggtgatttatggggcattatggagcagttggactatattcaagatttgggcatcgatgccatctactttacgcccatctttcagtctgccagcaatcaccgctatcatacccacgactattatcaagtagacccgatgttgggtgggaatgccgcttttaaggagttactagacgcggcccacgaacgcaatattaaagttgtcctcgatggcgtatttaatcattccagtcgaggatttttctttttccatgacgttttggaaaatggcccccattctccttgggtaaattggttcaaaatagaaggctggcctcttgcaccatatacaggtgagttaccggcaaattacgtaggttgggctgataatcgtgccttgcccgtatttaatcacgataacccagacgtacgggaatatattatggaaattgccgaatattggcttaaattcggcatcgacggctggcgattggatgtaccatttgaaattaaaactcctggcttttggcaagaattccgcgatcgcgttaaagccattaaccccgaagcttatattgtgggggaagtgtggggagattcccgtgagtggctagatgggacgcaattcgacggcgtgatgaattacttatttgccgggccgaccattgcttttaccgcaggcgatcgcgtagtcttagaacaagtccaaagccgcgactatcaaccgtatccgcccctattcgccgccgaatacgccaccaaaattcaggaagtactgcaactttatccttgggaaattcaacttacccaactcaacttattagccagtcacgatacagccagactaatgaccattgctggcggtgatcaagccagtatagaattagctaccctattactacttacctttcctggtgcgccgagtatctactacggtgatgaagtgggtttaccgggaggtatagaccccgattctcgccggggttttcccttagaagccaactgggatagagaaatttaccagactcaccgtcaattaatagccttacgccacgcttacccagccttacgcacaggtgagtatcaagttatttgggcgcaaggtgcattgtatgtatttgcccgtactttaggtaaggaagaactgattattgctgtaaatgtaggtacagcaccagcccaggctaatgtagatgttgctagtttgcagactcagccagataaaatcctgtatggcgaagcagaatttagctggcacaatacagaagaaacaaaacaactttccttaaatctccccccacgtagtggctgcattttgggtttaggggattag

SEQ ID NO: 748 - protein, 488 aa, Anabaena variabilis ATCC 29413
MQIQTPDWVKNAVFYQIFPDRFAISKQSRKRLLRDVRWEDWDAMPTLQGYKGGDLWGIMEQLDYIQDLGIDAIYFTPIFQSASNHRYHTHDYYQVDPMLGGNAAFKELLDAAHERNIKVVLDGVFNHSSRGFFFFHDVLENGPHSPWVNWFKIEGWPLAPYTGELPANYVGWADNRALPVFNHDNPDVREYIMEIAEYWLKFGIDGWRLDVPFEIKTPGFWQEFRDRVKAINPEAYIVGEVWGDSREWLDGTQFDGVMNYLFAGPTIAFTAGDRVVLEQVQSRDYQPYPPLFAAEYATKIQEVLQLYPWEIQLTQLNLLASHDTARLMTIAGGDQASIELATLLLLTFPGAPSIYYGDEVGLPGGIDPDSRRGFPLEANWDREIYQTHRQLIALRHAYPALRTGEYQVIWAQGALYVFARTLGKEELIIAVNVGTAPAQANVDVASLQTQPDKILYGEAEFSWHNTEETKQLSLNLPPRSGCILGLGD

SEQ ID NO: 749 - DNA, 1776 bp, Listeria monocytogenes str. 4b H7858
  CDS (1)..(1776): transl_table=11
atggaaaaagcagggatttatcatcaaccagcgagtagctatgcttatagttatgacgctaaaacactacatattcggattagaacgaaacgcttggatattagcgaggttactctaattgctgccgacccttacttatggaaagatggaaaatggcaaagtgaatcttatacaatgcgcaaaatcgcagaaacagaagagcacgattattggttttttgcaattacaccagaacatagacgtcttcaatatggctttttactaacagatacagaaggagaaacaacattttacggcggacgtggtttctttgagccaactgaggctaatttagctacgatggattattactttaaatttccatttatccatgcggtggatacttttgaggcgcctgaatgggttgggaatactatttggtaccagattttcccagaacgttttgcaaatgggaatccggctatttctccggaaaatgccttgccgtggggaagtaaagatccgaacacaacagactttttcggcggggatatagaaggaattatcgagcatttagattatttagcagagcttggtattaatggggtttatttgacacctgtgtttgaagcaccaaccaatcataaatacgatacggttgattataaaaaaattgatccacattttggagataaagaaacgtttagaaaattagttcaggaagcgcataaacgtgggattcgcattatgttagatgcggtgttcaatcacattggcgatacttcagcagagtggcaagatgttgtcttaaatgaagaaaaatctgcatatcgtgattggttccacatccatagtttccctgttcgtcaaaatgaaaatggcaatattgaaggagaaccaacactttcttacgatacatttgctttcacgacgcatatgccaaaattaaatacggctaacccagaagttcagaagtatctactggatattgcaacttactggattcgcgaatttgacattgatggttggcgcttagatgttgctaatgaagtagatcatgctttctggaaagaatttaaaaaggctgtccaagcggaaaaagaagatatttatattcttggtgaaatttggcatgattcgtggatttggttacttggagatgaattccacgccgtaatgaactatccatttacacaaacgattattgagaactttattgaagaaaaaatcacaccggagcaaatggtttctggtattaatgaacaatatatgcgctacccaaatcaagtgaatgaagtaatgtttaatatgcttgatagccatgatacggcgcgtattttaactcgtgctaataatgatgaggataaagtgaaacaagcgcttgccttcatgttcgcgcacactggttcgccgtgtatttattacggaactgaaatcggcatggacggaggaaatgacccaggttgccgtaagtgtatggaatgggatgaaacgaagcaaaaccaagatatgctagcgtttacgaaacaattaattgccctaagaaaagataaccaagcaattatcacatccggcgaattaacttggctaggtgcaagtagcgaaacgggcattacagcattttctaaagaattaaatggtgaaaaactgcatttccttttcaatcaagcaaaagaagataaagatttcacaatttcatttgaaaatacagcgacagatatttggaacaaccgagctgtaacagaaaatcttgttgtcccagcaaaaggatttcttgttgttaaagaaaacagctaa

SEQ ID NO: 750 - protein, 591 aa, Listeria monocytogenes str. 4b H7858
MEKAGIYHQPASSYAYSYDAKTLHIRIRTKRLDISEVTLIAADPYLWKDGKWQSESYTMRKIAETEEHDYWFFAITPEHRRLQYGFLLTDTEGETTFYGGRGFFEPTEANLATMDYYFKFPFIHAVDTFEAPEWVGNTIWYQIFPERFANGNPAISPENALPWGSKDPNTTDFFGGDIEGIIEHLDYLAELGINGVYLTPVFEAPTNHKYDTVDYKKIDPHFGDKETFRKLVQEAHKRGIRIMLDAVFNHIGDTSAEWQDVVLNEEKSAYRDWFHIHSFPVRQNENGNIEGEPTLSYDTFAFTTHMPKLNTANPEVQKYLLDIATYWIREFDIDGWRLDVANEVDHAFWKEFKKAVQAEKEDIYILGEIWHDSWIWLLGDEFHAVMNYPFTQTIIENFIEEKITPEQMVSGINEQYMRYPNQVNEVMFNMLDSHDTARILTRANNDEDKVKQALAFMFAHTGSPCIYYGTEIGMDGGNDPGCRKCMEWDETKQNQDMLAFTKQLIALRKDNQAIITSGELTWLGASSETGITAFSKELNGEKLHFLFNQAKEDKDFTISFENTATDIWNNRAVTENLVVPAKGFLVVKENS

SEQ ID NO: 751 - DNA, 1482 bp, Trichodesmium erythraeum IMS101
  CDS (1)..(1482)
atgcaaattcaaacaccagaatgggttaaacaggctgtattttaccaaatttttccagatcgttttgctaaagctcaaccaacgactgaaactggaaaaggaatagacaaaggttggtatcccagcagtctagaaccttgggatgaatatcctactcctcaaggttataaaggagggaacctctggggtgtcattaaaaaacttgactatcttcaggaacttggtatcacagctatttactttacaccaatttttcagtcaacctgtaaccaccgctatcatactcatgactattatcgagtcgatccaattttaggaggtaatgaggctttaagggtattaatagatactgctcacgatcgcaatattaaagtggttcttgatggagttttcaaccacgctagccggggtttttatttctttaacgatatcctggaaaacggtccttattctccctggttgcattggttcaaaatagaaaattggcctctgtctgcttacgatggtagtttacctgctaattatgtgggttggttagataaccgtgctttacctgtttttaatcatgacaacccagaggtcaaagaatacattatggaaattggagaatattggttaaaatttggtattgatggttggcggttggatgtaccttttgaagtgaagactcccgggttttggcaagaatttcgcgatcgcgttaaggctattaacccagaagcatatattgtgggtgaagtctggagtaactgcgcacaatggttggatggtactcagtttgatggagtgatgaattacttatttactggtccaactattgcttttactgtaggcgatcgtgtggatcttgagcaaattgaaggccgtgactatgtagcttatccggctatatctgctgttgaatacggtcaaaaaatgcaggagttactgcaactttacccttgggaaattcaattaactcaactcaatttattagatagtcatgatacagctagagttttgagtattgctaaaggggataaagcaagtgttgaattagcgactctgttgttaatgacttttcccggagcaccaagtatttattatggtgatgaggtaggtttaccgggtaagtttgaccctgactgtcgtcgtagttttcctactactgaaaaatgggatcgtgaagttctggaatatcataaacagttaattgctattagaaaagaatattcagctttgcgcactggtaattacgaagtgttgtttgccgagggaaatgtttatatttttgctcgtattttagaagaggaagaaattattgtagctgttaacattggtatagaagcagcaaaagtaaatgttatttttaataagcttaaatctcaacctaataaagttgtttatggtagttgtaaaatttcctggcaaggaggagatgaagctagtaaattagagttatatttgccaggaagaaaaggttgtattttggttaaagattaa

SEQ ID NO: 752 - protein, 493 aa, Trichodesmium erythraeum IMS101
MQIQTPEWVKQAVFYQIFPDRFAKAQPTTETGKGIDKGWYPSSLEPWDEYPTPQGYKGGNLWGVIKKLDYLQELGITAIYFTPIFQSTCNHRYHTHDYYRVDPILGGNEALRVLIDTAHDRNIKVVLDGVFNHASRGFYFFNDILENGPYSPWLHWFKIENWPLSAYDGSLPANYVGWLDNRALPVFNHDNPEVKEYIMEIGEYWLKFGIDGWRLDVPFEVKTPGFWQEFRDRVKAINPEAYIVGEVWSNCAQWLDGTQFDGVMNYLFTGPTIAFTVGDRVDLEQIEGRDYVAYPAISAVEYGQKMQELLQLYPWEIQLTQLNLLDSHDTARVLSIAKGDKASVELATLLLMTFPGAPSIYYGDEVGLPGKFDPDCRRSFPTTEKWDREVLEYHKQLIAIRKEYSALRTGNYEVLFAEGNVYIFARILEEEEIIVAVNIGIEAAKVNVIFNKLKSQPNKVVYGSCKISWQGGDEASKLELYLPGRKGCILVKD

SEQ ID NO: 753 - DNA, 1815 bp, Chloroflexus aurantiacus
  CDS (1)..(1815)
atgtatctgcgcttcagtggcagaccaggtgacacagcggtatttcggctccgtatggccgcagacgcaccggtcagtggggtcttcctccgcacctgcccggatggggaacagcattttacgccactgcgcgatctgggagtgcgcggggtgtgccggtggtgggaaggtgagctaccgatccgcatgctccgcaccaattaccgcttcctgatccgcgcagatgactgttcgcgctggtacagcgctggtggcatcacccgtcactaccccaccgacgcaaatgatttcgtggtactggccaactatcacgcgccagcctgggtacgtgatgcggtcttctaccagatttttccggatcggtttgccgatggcgacccgacgaataatgtccgcgatggtgcgtatctctaccacggacgaccggttgttgcgcgccgctgggatgaacgacccaaccgggcgaccggatcgatagagttctacggtggcgatttgcaagggatcgcgcagcgcatcgactatctgaccgatctgggagtctcggcactgtatctcaatcctatcttccgagcaccatcgaaccacaaatacgatgtcgaagactataccagcattgatccacacctgggaggtgaagcagggttactccgcttacgtgaggtactcgacgagcgagccatgaagctggtgcttgacatcgtaccgaaccattgtggagtgacccatccgtggtttgtcgctgcccaggccaacccacgagcaccaacagccgagttcttcatgttccgtcgtcatcccgacgactacgagagctggctgggggtcaagaccctgcccaaactcaattaccgcagtgtccgcctccgcgacgtgatgtacgcaggccaggatgcgattatgcgctactggttacgaccaccctatcggatcgacggctggcggattgatgttgccaatatgctggggcggttggggacagacaaccttggccacaagattggacgcgggatttggcgggcagtgaaggcagagcaaccggaagcctatctgctgggtgaacacttcttcgacggtactccccatctgcaaggtgaagagcttgatgccacaatgaattatcaaggcttcacctttcccatctggcgctggttgggagggtttgagttcaatccgcagcggcctgaagccgatccacgaccgattgcaaccgagacggtcgttgcgcaatggacggcatttcgggcagcgataccgtggcagatcgccagtcagcaattcaacctgttgggaagtcatgacaccccgcgtctacggacaatcgtaggcgatgatctggcgcgagtgcgggtagcgatgacgttactcttctgctatccgggggtgccgtgtatctactacggtgacgaaattggactgacgggcggcggtgatcctgattgtcggcgaccgatgccgtgggatgaacgagagtgggatcacgacctgcgggcgttcgtgcaacggctggcacgcttacggcgtcagtcgccggcgttgcgctggggcggctttcagcagctctacgcaaacggggaaacgattgccttccagcgcgaagcacctgaggagcgcatgatcattgtggtacggcgcagtgatgatgggcaacgcctgctgccggtgcgtcacggcgggctggctgatggggttcacctgcgggaactcttcagtggtgccgagacggttgtacgcaacgggatgctggacattgggaatttgccggccaccggtgcgcaaatctggcaaaccacagacaaagacaacgtgttctga

SEQ ID NO: 754 - protein, 604 aa, Chloroflexus aurantiacus
MYLRFSGRPGDTAVFRLRMAADAPVSGVFLRTCPDGEQHFTPLRDLGVRGVCRWWEGELPIRMLRTNYRFLIRADDCSRWYSAGGITRHYPTDANDFVVLANYHAPAWVRDAVFYQIFPDRFADGDPTNNVRDGAYLYHGRPVVARRWDERPNRATGSIEFYGGDLQGIAQRIDYLTDLGVSALYLNPIFRAPSNHKYDVEDYTSIDPHLGGEAGLLRLREVLDERAMKLVLDIVPNHCGVTHPWFVAAQANPRAPTAEFFMFRRHPDDYESWLGVKTLPKLNYRSVRLRDVMYAGQDAIMRYWLRPPYRIDGWRIDVANMLGRLGTDNLGHKIGRGIWRAVKAEQPEAYLLGEHFFDGTPHLQGEELDATMNYQGFTFPIWRWLGGFEFNPQRPEADPRPIATETVVAQWTAFRAAIPWQIASQQFNLLGSHDTPRLRTIVGDDLARVRVAMTLLFCYPGVPCIYYGDEIGLTGGGDPDCRRPMPWDEREWDHDLRAFVQRLARLRRQSPALRWGGFQQLYANGETIAFQREAPEERMIIVVRRSDDGQRLLPVRHGGLADGVHLRELFSGAETVVRNGMLDIGNLPATGAQIWQTTDKDNVF

SEQ ID NO: 755 - DNA, 1803 bp, Lactococcus lactis subsp. cremoris SK11
  CDS (1)..(1803)
atgtattactataatccatggaatttagattataagcaaccttttggtgcagtaaaagtagggcaagccattttattgaaatttgacgcaaatcaaactcaagtagaagtgaagtgcattattcgacgtgattttggaaaaagatatgaattccttatgagcagagatgagtcaggtttttttacagtcactatcccatttgatgaaaatgctggtctttatttttactattttgaaattttggagggctcagattgggaacaaaacaagcgtttttatgggagttctggaataggtggggaagggctgctctatactaacgaaaatgatattaaaccctatcagctgacagtttttgaaaaagaggacaaggcaccagcttggtatcgtgacgctgttttttaccagatttttcctgatcgtttccataatggaaatgaaaatgggcaagtcagccatccaaaaccgaattcttttatttatggaactaaatctgatacccctttttatgtgaaagaggaaaatggtgatattgctcgttgggatttctttggtggaaacctaagaggaatcattaacaaaatttcatatttaaaagaacttggaatcaatgccatttatcttaatccagttttttctgggacaagtaaccatcgttatgacaccaacgattatctaaaaatagattccatgttaggaactcaagaagattttcaagaattaatcaatttacttcatcaagaacaaatgcatttagttttggacggtgtcttttcacatgtaggtaaaaattcactttacttcaatatcaatggagattatggagatgatgaaggagcggcgaaaaatcctgactctccttattttgactggttcaagtttgaaaattatccttttgattataaatcttggtggggaattaaagatttacctgaaattgataaagataatgaatcctttcgtgattttatttatggtaggaaaaactctgttttatcaaagtggaatgacttgggaatagatggttggcgattagatgttgctgatgaattgcctgattcatttattaaagggattcgtgagaatcttgaccgttattcagaaaaaattctaataggagaaatttgggaggatgcttctaataagatttcttatggaacaagacgcaaatatattcttggcgggagcttacaggcttgtatgaactatccgtttcgtgatttaatcatcaatttattaaacggaaatcgctcatgtcaggatgtagctcatcaattgatgactttgcaggaaaactatcccaaagatattttttataacaacttaaataatttggggacccatgatacggaacgtattttaacaatggtcggaaaagaaaatctgccattagctgtttcactcttatttgttttaccaggaatcccttgtatttattatggtgacgaagcgggactttctggaggaaaggatccagaaaatcgtaaatattttccttgggatgatatttcaccagaaatatatgattattataagagttggacgaaaaagcgtctattagaaaatagtttgaaagaaggagaattttctagcttttatagtgacagactactaggaattttgcgctatacagattcagaagtttttgtcgaggtgattaatcccagtgaagatgaaatcaagatagattattcagaaattacttttttacaaaagtttgattttatgccaaaactaaaagatttactgacagagcaagtgattagtggaaaatcaaacatagatttgaaaatagaaagataa

SEQ ID NO: 756 - protein, 600 aa, Lactococcus lactis subsp. cremoris SK11
MYYYNPWNLDYKQPFGAVKVGQAILLKFDANQTQVEVKCIIRRDFGKRYEFLMSRDESGFFTVTIPFDENAGLYFYYFEILEGSDWEQNKRFYGSSGIGGEGLLYTNENDIKPYQLTVFEKEDKAPAWYRDAVFYQIFPDRFHNGNENGQVSHPKPNSFIYGTKSDTPFYVKEENGDIARWDFFGGNLRGIINKISYLKELGINAIYLNPVFSGTSNHRYDTNDYLKIDSMLGTQEDFQELINLLHQEQMHLVLDGVFSHVGKNSLYFNINGDYGDDEGAAKNPDSPYFDWFKFENYPFDYKSWWGIKDLPEIDKDNESFRDFIYGRKNSVLSKWNDLGIDGWRLDVADELPDSFIKGIRENLDRYSEKILIGEIWEDASNKISYGTRRKYILGGSLQACMNYPFRDLIINLLNGNRSCQDVAHQLMTLQENYPKDIFYNNLNNLGTHDTERILTMVGKENLPLAVSLLFVLPGIPCIYYGDEAGLSGGKDPENRKYFPWDDISPEIYDYYKSWTKKRLLENSLKEGEFSSFYSDRLLGILRYTDSEVFVEVINPSEDEIKIDYSEITFLQKFDFMPKLKDLLTEQVISGKSNIDLKIER

SEQ ID NO: 757 - DNA, 1755 bp, Lactococcus lactis subsp. cremoris SK11
  CDS (1)..(1755)
atgaacaaagctgcaatttatcatcgtcctgagtcggaatttgcttatctttatgcaaaaaatctgatgcatgttcgtcttcaaacacaaaagtctgatgtggaaaaagtcgaattattttatggcgatccttattcgtgggaagggcttgacaaccctgaaacacagtattgggctagtcaaaaagtagagatgaaaaagtatctttctactaatattagcgattattttgaggccgaaattactgttgcaacgaaacgagttgattacttatttgtcattacaggtttggatggagaaaaagtagtttacacagaccaaggaatgtttgattatgatgagagcttggtgactaaaaaatatggggctttccgtttgccttatttccatgaaagtgatcgttttaaagcacctgaatgggtcaaagaaacggtttggtatcaaattttccctgaacgttttgccaatggggatacaagcaatgaccctgaaggaacgaaagcttggaatacccaagatgttcccgaccgtcaagatttttatgggggagatttgcaaggggtgattgatcatctggaacatttgactgaacttggtgtgaatggtatttactttacccctattttccaagctttttctaatcataaatatgatacagaagattatatggaaattgataagcaatttggggataaggaattgtttaaaactttggtgaaagaagcacatgcgcgtggtattaaagtcatgttagatgcggtctttaatcacatcggagatacgtctgctcaatggcaagatgtattgaaaaatcaagaaaaatcaaaatttgcggattggttccatgttaatagttggccagcaacttatactccgactgatgattttgaaaatgctgagaatgcaacttatgatacttttgcctttactccacacatgccaaaactgaatacggctaacccagaggttgaagcttatcttttgaaagtagctgattattggatttctgagtttgatattgatgcatggcgtttggatgtggcggatgaagtggatcatactttctggaaaaaattccgcacaacttgtgatgcggaaaaagatgatttttatattttaggtgaggtttggcattctgcacaaccttggttagttggtgacgaattctctgccgttatgaactatgcttatactgatgcgattaaagatggtttgattacgaagaagatttctttggaacaaatggtttctaatattaatacgcaactgacattataccgtaagcaagtgaatcaactgatgtttaatgttttagattctcatgatacacccagaattttgactgttgcaaaaaataataaaaatttgatgaaattggtggaaacgttcaccttcatgcaaccaggtgtgccttgtatttattatggagatgagtatgcgttgacaggtggaatggatcctgagtgtcgtaaggtgatgccttgggaagaaaaagatcaagatttagagatgtttgacttctttaaaaatctgattgctctacgcaaacaatatcaaggaattttaagtgattcagaagtagaatggaaaatcgtagattcagaaaatggcattgtgaaatttgaacgtggatctttgaaagctattttcaatattggcgaaaaaccggcttatttttcggctgatgaagtgattttctctaatttggttgaccaaaataatattttacaatatggttttgtaatctataaatag

SEQ ID NO: 758 - protein, 584 aa, Lactococcus lactis subsp. cremoris SK11
MNKAAIYHRPESEFAYLYAKNLMHVRLQTQKSDVEKVELFYGDPYSWEGLDNPETQYWASQKVEMKKYLSTNISDYFEAEITVATKRVDYLFVITGLDGEKVVYTDQGMFDYDESLVTKKYGAFRLPYFHESDRFKAPEWVKETVWYQIFPERFANGDTSNDPEGTKAWNTQDVPDRQDFYGGDLQGVIDHLEHLTELGVNGIYFTPIFQAFSNHKYDTEDYMEIDKQFGDKELFKTLVKEAHARGIKVMLDAVFNHIGDTSAQWQDVLKNQEKSKFADWFHVNSWPATYTPTDDFENAENATYDTFAFTPHMPKLNTANPEVEAYLLKVADYWISEFDIDAWRLDVADEVDHTFWKKFRTTCDAEKDDFYILGEVWHSAQPWLVGDEFSAVMNYAYTDAIKDGLITKKISLEQMVSNINTQLTLYRKQVNQLMFNVLDSHDTPRILTVAKNNKNLMKLVETFTFMQPGVPCIYYGDEYALTGGMDPECRKVMPWEEKDQDLEMFDFFKNLIALRKQYQGILSDSEVEWKIVDSENGIVKFERGSLKAIFNIGEKPAYFSADEVIFSNLVDQNNILQYGFVIYK

SEQ ID NO: 759 - DNA, 1779 bp, Lactobacillus casei ATCC 334
  CDS (1)..(1779)
atgtttcaatttgattcatttaccgatcgccgaccttttggcgcggtgcaaaaaggcacggctgtcacattgacggcacaggctgatggtgcggtgacacaagccacacttgtcattatgccagatgaacattgcgatcaaacgcagtccttgccgatgacgaaaagccctaacggctacacagtgacgtttacgcctcctaatgccggtctttggttttatcattttgagttgcaaagcgacaatggccgcgaacgctttggtgcggtcggcggtggttttggcgggctaggtcagctttaccctgaaaatgtggatgtggttaattatcagatgaccgttgtgaccgcatttgatccggttccggcgtggtatcaaaatgcccgtttttatcatatcttcgtagatcgcttcaataatgggaatgctgacggtcacgtgaatgctccgaaggaaaactcttttctgtatgggcgaaaaaccgatcggcccatgtatattcgcgggaacgatggcgagatcattcgctgggatttttacggcggtaatctgactggcattcaacaaaagctgccattattggcagcccgtggcatcaacgccttatatttaagtccaatttttcaggcgcggagcaatcatcggtatgacaccggcgattattttgcaattgatgaagtcttaggttcgctgcatgactttaagcagtttttggcggcagcgcatcagttggggatgcatgtcattctggatggcgtgtttaaccacgtcggcgctgatagccgctacttcaatgccgtcaatgaatattcagacgtgggtgcggctaatagcttggattccccatatgcctcgtggttttcattcaagcgatttcctgatgactacaatagctggtggggcgtgaaggatctgccagccatcaataaggataatcaagattttcatgacttcattgcggctaaaaaaggttcggtgatcagttattggactgacttaggcgttgatggctggcgcttagatgttgccgatgaattgatggacgattttatccggcagattcgcagcacgcttgatcaatttccggagcgggtgctgatcggcgaagtctgggaggatgcctccaataaacaggcttatggcaagcggcggcaatattttgaaggcggcgaattgaatgcagtcatgaattatccgttgcgatccatgttgattgacctgacaaatgggcaattaaacgcggcaggattcgttcgtcaattgatgacgttgaaggagaattatccaacaaatgcgtttgcgttcaatttcaacaacattggcagtcatgatacaccacggattttaacgatgttggatggtgatcggcgtaagttgcagtttatcgtctcgctattttactggctgcctggggtgccgtgcctttactacggggatgaggccgggttaactggcggtaaagacccggataaccgcgccttttatccatggggccatgaagatcaggctgttttggatatttatcaaatcgcgcttcagacccgcatcgaccagcccgccttagcagccggcgccgcttttttcccatttacgtttgaagacagttttggcttcgtccgccaaaatgatacccaaacgctggtggttctggccaatccaactggatcaccacaagtgttacaggatccgcatgctgaattagtgccaaaaagtttgcgcgctttattgccagtaggcacgatggtaccggcaggcggtgtgatttggcagcagatttaa

SEQ ID NO: 760 - protein, 592 aa, Lactobacillus casei ATCC 334
MFQFDSFTDRRPFGAVQKGTAVTLTAQADGAVTQATLVIMPDEHCDQTQSLPMTKSPNGYTVTFTPPNAGLWFYHFELQSDNGRERFGAVGGGFGGLGQLYPENVDVVNYQMTVVTAFDPVPAWYQNARFYHIFVDRFNNGNADGHVNAPKENSFLYGRKTDRPMYIRGNDGEIIRWDFYGGNLTGIQQKLPLLAARGINALYLSPIFQARSNHRYDTGDYFAIDEVLGSLHDFKQFLAAAHQLGMHVILDGVFNHVGADSRYFNAVNEYSDVGAANSLDSPYASWFSFKRFPDDYNSWWGVKDLPAINKDNQDFHDFIAAKKGSVISYWTDLGVDGWRLDVADELMDDFIRQIRSTLDQFPERVLIGEVWEDASNKQAYGKRRQYFEGGELNAVMNYPLRSMLIDLTNGQLNAAGFVRQLMTLKENYPTNAFAFNFNNIGSHDTPRILTMLDGDRRKLQFIVSLFYWLPGVPCLYYGDEAGLTGGKDPDNRAFYPWGHEDQAVLDIYQIALQTRIDQPALAAGAAFFPFTFEDSFGFVRQNDTQTLVVLANPTGSPQVLQDPHAELVPKSLRALLPVGTMVPAGGVIWQQI

SEQ ID NO: 761 - DNA, 1827 bp, Deinococcus geothermalis DSM 11300
  CDS (1)..(1827): transl_table=11
atgaacatcatctttgccgacctgcccgcgacccacgaccacacgcccgcctacacctctcggctcggtgccgctgtgggtgagctggtgacgctgcgcctcaagacgacgctgccggtgatcgcagtgtttctcaaactgctcgaacacggtgaaatcacgacccaccctgcccgcgagatcgggccgctcgacggcgagggccgctggttcgagttcgacctgcgcctgcacgcccgccgggtgcattatgcctggcaactccagaccgctgaagacaactggcacttcaccatggcgggcctgcaccacacccgccgaccctaccgcgactggtttcactacgtggcggactaccaggcgcccacctgggtctggaaaagcgtcttctatcagatctttcccgaccgcttccgcaacggaaaccctgcaaacgacgtgcagaccggcgagtatgtctacagcggtgccccggtggttcacgtgccctgggacgtgccacccacccgcgaactcgacattcacgcccactacggcggcgacttggagggggtcgcccaggccatgccctacctggccgatctcggcgtcaacgcgctgtggctgacccccatcttcgtgagtcccagcgcccaccgctacgacatcaccgactaccgcaccattgatccacacctgggcggcgaggcggcctttggcgagatgctgcgcgcggcgaatgcatacgggatccggatcgtgttggacggcgtgtttaaccataccggcagcgagcatgcgcttttccaacgggcgctccatgacgcctcggctcccgagcgcgagctgttcaccttccgcgaggccacaggcggcaagcctccctacgcggcctttttcgacgtgcccaccctgcccaagatcgactaccgctcggcagtcgccgtgaacgagttcctggcgggcgaggagagcgtggtgcgcttctggctgcggcggggggcggcgggctggcggctggatgtggcgcagcagatcgggcggggcggcaccgacgagggcaacctcgaactgcatcgccagcttaagcaggccgcccgcgaggaacggcctgacgcctacatcttcggagagcgcttctttgattcagaagcggcgctgaccggcgagggcgaggacggcgtgatgaattatcacggtttcggcctgccgctgatggagtggtttgcaggcgaacattacctgggctttcgctcgcgcatgacgacggcagaactgctcgacctgctgtgggacgcttaccacgtgttggcgccgcagctggcgctgaaccagttcaacctgctcgactcgcacgacatcccgcgtgccctctcgcggctgggggagaacaagaccaagctgcgcgccgccctcacgctgctgatgggttatcccggcgtgccctgcctctactacggcaccgagatcggcctctcgcagctcgagcgcggcctgatgccctttaaccgcgctccaatgccctgggacgaaacccgctgggaccttgacctgcgcggctttgtgcaggccctgatccgggttcgccgctccgcacgggtcttgcaggagggagcactgcgctttttgttggaggagtcggacgctctcgggtatctgcgagcctacacccaccctgacggacggcgtgaactggccgccgtgctgggcagccgccgagggagccagcacgaggtcaccgtcacattgcctcggggtgactggcgggacgcgctgaccggcgagcttgtctcccggggcggtgagacgcggctcgacgtggcccaggggcggttgctgttggcctga

SEQ ID NO: 762 - protein, 608 aa, Deinococcus geothermalis DSM 11300
MNIIFADLPATHDHTPAYTSRLGAAVGELVTLRLKTTLPVIAVFLKLLEHGEITTHPAREIGPLDGEGRWFEFDLRLHARRVHYAWQLQTAEDNWHFTMAGLHHTRRPYRDWFHYVADYQAPTWVWKSVFYQIFPDRFRNGNPANDVQTGEYVYSGAPVVHVPWDVPPTRELDIHAHYGGDLEGVAQAMPYLADLGVNALWLTPIFVSPSAHRYDITDYRTIDPHLGGEAAFGEMLRAANAYGIRIVLDGVFNHTGSEHALFQRALHDASAPERELFTFREATGGKPPYAAFFDVPTLPKIDYRSAVAVNEFLAGEESVVRFWLRRGAAGWRLDVAQQIGRGGTDEGNLELHRQLKQAAREERPDAYIFGERFFDSEAALTGEGEDGVMNYHGFGLPLMEWFAGEHYLGFRSRMTTAELLDLLWDAYHVLAPQLALNQFNLLDSHDIPRALSRLGENKTKLRAALTLLMGYPGVPCLYYGTEIGLSQLERGLMPFNRAPMPWDETRWDLDLRGFVQALIRVRRSARVLQEGALRFLLEESDALGYLRAYTHPDGRRELAAVLGSRRGSQHEVTVTLPRGDWRDALTGELVSRGGETRLDVAQGRLLLA

SEQ ID NO: 763 - DNA, 1491 bp, Deinococcus geothermalis DSM 11300
  CDS (1)..(1491): transl_table=11
atgccgccctctacaccctcttccgaagcacaccctctcacgcccgaatgggtcgcggacgccgtcttctatcagattttccccgaccggttcgcacgcagcgggcgagtgccgggcctgaaccttcagccctggggcagcccgccgcaggtgcacgggtatatgggcggcgacctgtggggggtcacccagcatctggaccacatcggggcactgggggtaaacgcgatctacttttgcccggtatttcagtcggcttccaaccaccgctaccacacccacgactactaccgggtagatcccatgctggggggcaacgaggcgctgcgggcgctgatcgaggcggcgcatgcgcggggcatccgcatcgtgctggacggcgtctttaaccatgccagccggggcttttttcagttcaacgacctcttggaacagggcgaggcgagcgcctaccgtgactggttccatgtggagggatggcccctgcacgcctacgacgacacccgaccggcgaactatcaggcgtggtggggccttcgcgcgctgccgaaattcaacaccggcaacccggccgtccgcgagttcttgtgggacgtgggcacgtattggatggagtttgggattgacggctggcggctcgacgtacccaacgaaatcgatgacgacgagttctggcgcgagttccgccgccgcgtgaaggccatcaatcccgacgcctacatcgtgggcgaaatctggggcgacgcgcaccgctggcttgccggggaccagttcgacgcggtgatgaattatcacttcacccggccctgtctggcgttttttgcggcgcgaaccctcgcacaggcggccaacgagtccaccggcctaggccgtgtggagccactcgacgctgccgccttcgcccgccgcatgaccgagatcacagcgctgtatcaccccgagatcgtccgcgcgcagctcaacctgctcgactcacacgacacagcccgcttcctgaccgccgcgggcggcgacgcgaccgcctttcgcctcgccagcatctttcagatgacctacgtgggggcgccgtgcatctactacggtgatgagatcggtcttcccggcggccctgaccccgactgccgccgcgctttcccctggcacgacgaggcgagctgggacaaagagacgctgagcctgctgcaaaagctcaccgccacccgccacgccacccccgccctgcgccggggagcattccgcttcacccacgcggaaggcgaggcgctggtctacgtccgcgaacacgccgccggcaacgcctacatcgccatcaatgccgcccaagcccccgcccgcctgcccctcagcgacgtgcagcccggccgataccgcgacgccctgagcgggcagcgtcacgagttgagcggagaaacggaggtcgaggttccggggcgcgcggcggtggtgctggtccgggcggaggaggattcgcggcacaccgcgcggcactga

SEQ ID NO: 764 - protein, 496 aa, Deinococcus geothermalis DSM 11300
MPPSTPSSEAHPLTPEWVADAVFYQIFPDRFARSGRVPGLNLQPWGSPPQVHGYMGGDLWGVTQHLDHIGALGVNAIYFCPVFQSASNHRYHTHDYYRVDPMLGGNEALRALIEAAHARGIRIVLDGVFNHASRGFFQFNDLLEQGEASAYRDWFHVEGWPLHAYDDTRPANYQAWWGLRALPKFNTGNPAVREFLWDVGTYWMEFGIDGWRLDVPNEIDDDEFWREFRRRVKAINPDAYIVGEIWGDAHRWLAGDQFDAVMNYHFTRPCLAFFAARTLAQAANESTGLGRVEPLDAAAFARRMTEITALYHPEIVRAQLNLLDSHDTARFLTAAGGDATAFRLASIFQMTYVGAPCIYYGDEIGLPGGPDPDCRRAFPWHDEASWDKETLSLLQKLTATRHATPALRRGAFRFTHAEGEALVYVREHAAGNAYIAINAAQAPARLPLSDVQPGRYRDALSGQRHELSGETEVEVPGRAAVVLVRAEEDSRHTARH

SEQ ID NO: 765 - DNA, 1968 bp, Arthrobacter sp. FB24
  CDS (1)..(1968): transl_table=11
atgccggcattcctcccgccctgccccctcccgcaccacgacggttcgccgcttcatgtgcctcggcgcgccggcctcggcgatgatgccgggctctgcgtgcggatacccgcggcatggggccgtgccgcccgggtctgggtgcggtcggtccaggacggtgaaccccggtacgacgccgcgcgcagcctgggggagcttgacggctgggtttggtgggaagcggaaatgaccgtcaccaacccggtggcccggtaccgcttcctgctggaagtcgcggatagcgagcacgacggcggtactcccggcagcggacagacgggtagtggacatgggggcagcaccccggggtactggagcctcaacgcccagggcctgttccgccgcgacgtctccgactacgcggacttccgcctgaccaccttcccggcagcgccgcagtggctgcgccggggaacgatgtaccaggtgtttccggaccgcttcgcgcgctccgccgacgccggttcgcgtccggtgcctgactgggccataccgtccgcatgggaccacacgcccgtggagggaaccggaccggccacgccgttccagttctacggcggcgacctcaacggggtggccgaaaaactggaccatatccagcaactcggcgccgacgtcatctacctgacacccttcttcccggcacgctccaatcaccgctacgatgcctccaccttcaacgcagtggatccgctcctgggcggcgatgatgccctcgtgacgctggtggaagcggcccatgcccgcgggatcaaagtgatgggcgacctcacggccaaccattcgggcgatgcccacgagtggttccggcaggcgctggccgatcccgcatccgccgaggccggctactactacttcacagggaccgggaaacaaggcgccaccgaagcgggtgccagggcctacgaatcctggtacggcgtcgcctcgctgcccaagctcaactggtcttcagggggcctgacggacaagttcgtcctggacgatgactcgccggtggcgcgctggctcaggcccccgttcaacctggacggctggcggatcgacgtcggcaacatgaccggccggctgggcgccacggacctcaaccgggaggtggcctgcctgatcgcggaccgggtcagggacatcaacccggaagccgcactgctggccgaagccaccaacgatgccgcgccggacttcaccggcgaacactggcacggggccatgacctacgccaacttcacccgcccgctgtggtcctggctggcaggggacgccgcgcacgtcaattttttcggcaccccccttgcgggccccaaccggatgggagccgaggacttcctcgccacccacctggacctggcatcggccttcagctgggatctccggctgcagaacatgaacgccttgaacagccacgacaccgcccgtgcagccacggtgatgatcgacggcgggcagctgcttggggccgtcatgatgttcacgattcccggtgtcccggtggtcttcgccggagacgagtttggcctcaaggggtacaacggcgaagactccaggacgccgatgccgtggaacgacccttcccggattggggcggacctccgtgccagctattcggccatggcagccctgcggcggaagcagccggcgctcaccggaggcggaatccgctggttgcatgccgacggcgacgcgctcgcctatatccgcgagacagcagagagcgcggtcctggtgttcgtggcccgcgcacccgcccgggccgacctcgcggccggcgcactgtctccggcccagttctccgccctcgcggcagatcccgcattctgcacggccgacgtccggaccgatgcggcggcccggagtgccggcacccggatcagcgcgggccaagcagcggccgcggtgtggatacttcccggaacccggacaccgtaa

SEQ ID NO: 766 - protein, 655 aa, Arthrobacter sp. FB24
MPAFLPPCPLPHHDGSPLHVPRRAGLGDDAGLCVRIPAAWGRAARVWVRSVQDGEPRYDAARSLGELDGWVWWEAEMTVTNPVARYRFLLEVADSEHDGGTPGSGQTGSGHGGSTPGYWSLNAQGLFRRDVSDYADFRLTTFPAAPQWLRRGTMYQVFPDRFARSADAGSRPVPDWAIPSAWDHTPVEGTGPATPFQFYGGDLNGVAEKLDHIQQLGADVIYLTPFFPARSNHRYDASTFNAVDPLLGGDDALVTLVEAAHARGIKVMGDLTANHSGDAHEWFRQALADPASAEAGYYYFTGTGKQGATEAGARAYESWYGVASLPKLNWSSGGLTDKFVLDDDSPVARWLRPPFNLDGWRIDVGNMTGRLGATDLNREVACLIADRVRDINPEAALLAEATNDAAPDFTGEHWHGAMTYANFTRPLWSWLAGDAAHVNFFGTPLAGPNRMGAEDFLATHLDLASAFSWDLRLQNMNALNSHDTARAATVMIDGGQLLGAVMMFTIPGVPVVFAGDEFGLKGYNGEDSRTPMPWNDPSRIGADLRASYSAMAALRRKQPALTGGGIRWLHADGDALAYIRETAESAVLVFVARAPARADLAAGALSPAQFSALAADPAFCTADVRTDAAARSAGTRISAGQAAAAVWILPGTRTP

SEQ ID NO: 767 - DNA, 1728 bp, Clostridium thermocellum ATCC 27405
  CDS (1)..(1728): transl_table=11
atgaaacttgaggcaatatatcacaaaccttacagcgagtttgcatttcctgttgctcccgacactctggtaatacggctcaggacggctaaaaacgatgtaaacacctgcattctcatctatcatgaaaagtatgatacgtcacaaagaggaaaagtgaaaatggataaagttgcaagcgatggaatgtttgactattacgaggtggagcttaatgtcggtataaagagaattaagtatatgttttatcttgaggataattattcaataaaatggtacagcagcgacggattttttgattatatgcctcagtggggacattttacctattcttatatatgcaaagacgacatatttcatgaggttgaatggtttcgtaattcaacaatatatcagatatttcccgacagatttgcaaagtttccgccggataccgaaaattcgggcaaaagaacgatacatgggggcaatattaaagggataatcgaccggtttgatcatttagtcaaacttggagttgatgtggtttatttaaatcccatattcaaatcggaatcttatcatcgctatgatgttgtcgattattatgaaattgacccgatgtttggaagtaaagaagagctcagggaattgatggacttgtgtcacaaaaacggtataaaagtaatatttgacggagtttttaatcactccggagacaagttttttgcattcagagatgttgtggaaaaaggagaaaaatcaaagtatgcaaactggtattttataaattcttttcccgttcagggatatccaagacccaattatgaatgcttttccttttatggaggaatgccgaagcttaacaccggaaatcctgagacggcaaaatactttcttgatgtggtaaagtattggacagtggagtttggggtggacggatggagacttgatgcggcggatgaggtggaccgaaagttttggagaaagcttagggatatgctgaaagatttgaacaaggatgtggtgctgattggcgaaatatttgacgaggcgtcttcgtggctttggggagaccagtttgactcggtgataaattatccgttgaaagccatgataaatgacctttttgcctataggtccattgatgtggagactttcaggaacagaataagcggctatattatgaagtttaacaaaaaggtgctaagcagcctggtaaatataataagcactcatgacacgccaaggtttttgactctttgcaacggagatgaaaagaggtttgagatggcagtagtgttccagtttacctttcctggagttcccctcatatactacggcgatgaaatagggatggaaggcgaaggagaccctgattgcagaagaccgatgatatgggacgaagcgaaatggaacaaaaaaactctcgagttgtataaattcctgattggcttgaggaagaggttcgatgccttgagaactggagaatatggagaacttcctgtaacaggatgcaatgggatactggcatacagaaggggccggggagaaaacggaattattgttgccatgaatacattggaccgaaaggaaaatgtcgtagtagaaacaggagattcttttgacacggtaaaagcttttgagtctttgaaagacgaagaaagactgaatgttgacaaaaaaaggataaacatatgcttaaatccgtttgagtggaggatttacaaagcctgcggcgaattataa

SEQ ID NO: 768 - protein, 575 aa, Clostridium thermocellum ATCC 27405
MKLEAIYHKPYSEFAFPVAPDTLVIRLRTAKNDVNTCILIYHEKYDTSQRGKVKMDKVASDGMFDYYEVELNVGIKRIKYMFYLEDNYSIKWYSSDGFFDYMPQWGHFTYSYICKDDIFHEVEWFRNSTIYQIFPDRFAKFPPDTENSGKRTIHGGNIKGIIDRFDHLVKLGVDVVYLNPIFKSESYHRYDVVDYYEIDPMFGSKEELRELMDLCHKNGIKVIFDGVFNHSGDKFFAFRDVVEKGEKSKYANWYFINSFPVQGYPRPNYECFSFYGGMPKLNTGNPETAKYFLDVVKYWTVEFGVDGWRLDAADEVDRKFWRKLRDMLKDLNKDVVLIGEIFDEASSWLWGDQFDSVINYPLKAMINDLFAYRSIDVETFRNRISGYIMKFNKKVLSSLVNIISTHDTPRFLTLCNGDEKRFEMAVVFQFTFPGVPLIYYGDEIGMEGEGDPDCRRPMIWDEAKWNKKTLELYKFLIGLRKRFDALRTGEYGELPVTGCNGILAYRRGRGENGIIVAMNTLDRKENVVVETGDSFDTVKAFESLKDEERLNVDKKRINICLNPFEWRIYKACGEL

SEQ ID NO: 769 - DNA, 1461 bp, Crocosphaera watsonii WH 8501
  CDS (1)..(1461): transl_table=11
atggtcataaaaacccctgaatgggtaaaaaacgccattttttatcaaatttatcccgatacctttgcgagaaaggttccagatcgccaaaaatggttattagatgtacccttggaagactgggaagcccccccaacctcccaaggatacaaaggaggcaacctctggggtgtgatcgataaattggattatttacaagatttaggggttgatgctctctatttgacccctatttttcgctctgcttgtaaccatcgctatcatactcaagattattatgcgatcgatcctttattgggagacagagaagcttttgatcacttgttgaaaactgcccatgataaagggtttaaggtggttttagatggggtatttaatcacgctagtcgtggctttttcttttttaacgatatcctggaaaatggaccgaattccccttggttagattggtttaaaatcgaagggtggcctttatctgcctacgatggcagtcgtccggctaattacgtctcctggatagattatcgtgctttaccccagtttaaccacgataacccggcagtgagggaatatatcatgcaagtgggggaatattggttacaacaagggatcgacggttggcggttagatgtacccaactgtgttgaagcagagggtttctgggaggaatttcgagaacgggttaaagctgtcaaccctgaagcctatatcgtcggagaaatcgtttctgatgctactcaatggctagatggcaagcaatttgatggggtgatgaattatccttttgctcgtttaaccgcttgttttgtcatcggcgatcgccttgacaaggagactatccccagtttttataaaccttacgaaaccctcgatgcagccgaatacgcaaagggacttgaggaattattagcccgtcatccttgggaaattcaattaacccagctaaacctacttgatagtcacgatacttctcgttttctaactatggcaggaggcgatcgcacttccttacagttagctacgttattgttgtttacctttcctggcactcccaacatattttatggggatgaaattggtattgaaggtggcaaagatcccgatgggagaaaaggtttccctacagaagaaaagtgggagcaagaaaccttaacctatcataaacaattaatccaaatcaggaaaaaatacacggctttacggacaggagaatatagagttatcactgctcaagaaaatgtctatgtctttgcccgtattttaggagaagaagggttgattattgcagttaataatggagaagataaaacagaaatacaaatagataaattcgacaaagtgtcctcaatattacagactaaaccgagtcagattatttatggagaagggtcaattaattggcatgataaccagttaaaaataacaatgcatcctcgttctggcctagttatagccccttaa

SEQ ID NO: 770 - protein, 486 aa, Crocosphaera watsonii WH 8501
MVIKTPEWVKNAIFYQIYPDTFARKVPDRQKWLLDVPLEDWEAPPTSQGYKGGNLWGVIDKLDYLQDLGVDALYLTPIFRSACNHRYHTQDYYAIDPLLGDREAFDHLLKTAHDKGFKVVLDGVFNHASRGFFFFNDILENGPNSPWLDWFKIEGWPLSAYDGSRPANYVSWIDYRALPQFNHDNPAVREYIMQVGEYWLQQGIDGWRLDVPNCVEAEGFWEEFRERVKAVNPEAYIVGEIVSDATQWLDGKQFDGVMNYPFARLTACFVIGDRLDKETIPSFYKPYETLDAAEYAKGLEELLARHPWEIQLTQLNLLDSHDTSRFLTMAGGDRTSLQLATLLLFTFPGTPNIFYGDEIGIEGGKDPDGRKGFPTEEKWEQETLTYHKQLIQIRKKYTALRTGEYRVITAQENVYVFARILGEEGLIIAVNNGEDKTEIQIDKFDKVSSILQTKPSQIIYGEGSINWHDNQLKITMHPRSGLVIAP

SEQ ID NO: 771 - DNA, 1785 bp, Exiguobacterium sp. 255-15
  CDS (1)..(1785): transl_table=11
atgaataaagcagctgtgtttcaccgggccctgtctccgtatgtctatacatacgatcaagaagcggttcatatccgcttgatgtcagccaaaggggacctggaccgtattgaactgatccacggggatccttatgaatgggatgcagaaaaagaggaagatcgggactggaactttgatccggataaagaaaaattttggaaaacggagacgacagacatgacgtttgccggatcggatgcgacacatgatttttggttcgttgccatccggcccccaaagaagcgggtccgctacggctttaacgttcatgctaacggtgaatcggccgtctatacggaacgcggctggtacgatgaagtaccgctcgatcatccgggctactactttgccgtcccatatatgaatgcggtcgatgtatttgatgcgccgtcatgggtcaaagacaccgtctggtatcaaatttttcccgatcggttcgcgaacggggatttgacgaatgatcgtccgggtaccatcgcctggggtgccgaagcaccggcgtttgacaatcatttcgggggcgattttcaaggagtgattgatcatatcgattacttaaaagagctggggattaccggaatttatttttgtccggtctttgtcgcaccgtcgaatcataaatacgatacgttagattatttacgactcgatccggcctttggaacagaagagacgttccgggaaatgattcatttgctccatcaaaatgggattcggattttactggacgccgtctttaatcacgtcagcgttgatcatccggccttccaagacgtcattgcgcatggcaatgagtcgcagtatgcgaattggtttatgatggactcgttcccggtccaatcgacaccagtgccgaactatgaagtttttgcctttgaagggaatatgccgaaacttaatacggcgcatcctgatgtaaaagagtacttgttaaaagttgggcgttactgggtggaagagttccacgtcgacggatggcgactggatgtcgcgagtgaagtggatcatgctttttggcgtgagttccggcgtgaagtccgggcagcgaatccggaagcctatattgtcggcgagtgttggacagattcacaaccgtggttgctcggcgatcagtttgatgcggtcatgaactacggattgacggaagctttcttaacattttttgcgacgaatgaaagtacggcgtctgaattcagtcatgcaatcgtcaggaatctgaacagcaatacgatgaatgtcaacgaagtgatgttcaatctggtggattcgcatgatacaccccgtgccttgacgcgggcgaatggggaccgtgatcggatgaaactgttgatgctgtcactgctgacattcacgggaagtccggtcatctattacggagatgaaatcggtatgacaggcggtcaggatccggataaccggaagtgtatggtctgggatcaggcggaacaggacagggatctcttggcgtatatcacaaagttggttgatttacggaaatcgcaccccgctctcgccaacgcgagcggctatcaattcgaacaaatggatgatgagacggcaagtttcctcgttcgtcgtcagtctgatgaagcgacctatttgattggatttaacaatggttcagaagaaatccgctttgacttggacaaagcagcggttgatttaatggacggacaacggtatttgggaaccgtcaccgtacgtccgttgtccggaaaaattctccgggtggaaacaacataa

SEQ ID NO: 772 - protein, 594 aa, Exiguobacterium sp. 255-15
MNKAAVFHRALSPYVYTYDQEAVHIRLMSAKGDLDRIELIHGDPYEWDAEKEEDRDWNFDPDKEKFWKTETTDMTFAGSDATHDFWFVAIRPPKKRVRYGFNVHANGESAVYTERGWYDEVPLDHPGYYFAVPYMNAVDVFDAPSWVKDTVWYQIFPDRFANGDLTNDRPGTIAWGAEAPAFDNHFGGDFQGVIDHIDYLKELGITGIYFCPVFVAPSNHKYDTLDYLRLDPAFGTEETFREMIHLLHQNGIRILLDAVFNHVSVDHPAFQDVIAHGNESQYANWFMMDSFPVQSTPVPNYEVFAFEGNMPKLNTAHPDVKEYLLKVGRYWVEEFHVDGWRLDVASEVDHAFWREFRREVRAANPEAYIVGECWTDSQPWLLGDQFDAVMNYGLTEAFLTFFATNESTASEFSHAIVRNLNSNTMNVNEVMFNLVDSHDTPRALTRANGDRDRMKLLMLSLLTFTGSPVIYYGDEIGMTGGQDPDNRKCMVWDQAEQDRDLLAYITKLVDLRKSHPALANASGYQFEQMDDETASFLVRRQSDEATYLIGFNNGSEEIRFDLDKAAVDLMDGQRYLGTVTVRPLSGKILRVETT

SEQ ID NO: 773 - DNA, 1788 bp, Exiguobacterium sp. 255-15
  CDS (1)..(1788): transl_table=11
atgctgaaagaagctgttttccaccgcgcgatgtcaccgttcgtctataagtatgatgacaaaaccattcatgttcgactgcagacgaaaaaaaatgacgtcgaccatgttgatcttatttggggagatccgtacgactggcataccgaaaacccggatgatgccgattggaactttgatccgtccaaatcaaactattggaatactttcgaaacccctatgaaacggagcgggtcagatgagttattcgattattggttcatcgatgtcgttcctcctttccgccgacttcgttacggattccggcttcacgacggacattcgagtcaagtctttaccgaacgtggctggtttgatgaaaagccgctagatgataccggatactacttctgtgttccttttttaaacaaagtggatgtgttccatgctccggactgggtgaaggatacagtgtggtatcaaatcttccccgaccgctttgccaacggagattcgacgaatgatccggccggtacccttccatggaatagtacggcacctacaacgacaaatctgttcggcggtgattttcaaggcgtcattgataaaatcgattacttagtggatctcggcatcacaggcatttacttctgtccaattttcgaagccaagtccaatcataaatacgacacgattgattatttggaaattgatccgcagttcggaactaaagaaaagtttaaggaaatggttgatttactgcatgcaaatggaattcgcatcatgctggatgccgtctttaatcatgccggtttccaccataaagcattcgccgacattcgggaacacggcagcaattcttcttaccgggattggttccacctccggaacttccctctcgtaaccgagccgatgccgaactatgacacgtttgcgtttgttccggaaatgccgaagttcaatacggaaaatccggaagtaaaagaatacttacttcatgtcgcccgttactgggtcgaagaattcgggatcgacggctggcggcttgatgttgccaacgaagtcgatcatgccttctggcgtgacttccgttctgtcgtcaaggaagcggatccggagacgtatattctcggtgaaatttggcacgattcacaggaatggttgctcggtgaccaatttgatgccgttatgaactatccgttcacgaatgctgcacttaatttctttgcactcgataagacatctgcttccacctatgccaatgacatgtcgcatgtcttattctcaaacacggtcaacgtcaacgaagtatcgtttaacttaatcggttcacacgatacgccgcgtgccttgacccgtgccggaaacgacaaaaacaagatgcgtctgctgctgttatccatgctgaccttctccggaagtccggttatctattacggagatgaaatcggactcgacggtgatcaggatccgggttgccggaaatgtatgccgtggaatccggaagagcaggatttgaatctgttgatgtacacgaaacatctgcttcagttacgaaagcagcacaggacacttgccaatcacggacagatttcattcgtccatgccgacgatgaaaccaataccatcgtcatgcgtcgtatgagtcaggatgggacgtattacgtctatttcaataactcgaatcatcaggcgacaatcccggctcctcagtccggccaaggaatggatctcttttcgaacacaccacttccttcattagaagtgacgctcgctccgtatacaggaactatcattcaagtgatttga

SEQ ID NO: 774 - protein, 595 aa, Exiguobacterium sp. 255-15
MLKEAVFHRAMSPFVYKYDDKTIHVRLQTKKNDVDHVDLIWGDPYDWHTENPDDADWNFDPSKSNYWNTFETPMKRSGSDELFDYWFIDVVPPFRRLRYGFRLHDGHSSQVFTERGWFDEKPLDDTGYYFCVPFLNKVDVFHAPDWVKDTVWYQIFPDRFANGDSTNDPAGTLPWNSTAPTTTNLFGGDFQGVIDKIDYLVDLGITGIYFCPIFEAKSNHKYDTIDYLEIDPQFGTKEKFKEMVDLLHANGIRIMLDAVFNHAGFHHKAFADIREHGSNSSYRDWFHLRNFPLVTEPMPNYDTFAFVPEMPKFNTENPEVKEYLLHVARYWVEEFGIDGWRLDVANEVDHAFWRDFRSVVKEADPETYILGEIWHDSQEWLLGDQFDAVMNYPFTNAALNFFALDKTSASTYANDMSHVLFSNTVNVNEVSFNLIGSHDTPRALTRAGNDKNKMRLLLLSMLTFSGSPVIYYGDEIGLDGDQDPGCRKCMPWNPEEQDLNLLMYTKHLLQLRKQHRTLANHGQISFVHADDETNTIVMRRMSQDGTYYVYFNNSNHQATIPAPQSGQGMDLFSNTPLPSLEVTLAPYTGTIIQVI

SEQ ID NO: 775 - DNA, 1761 bp, Moorella thermoacetica ATCC 39073
  CDS (1)..(1761): transl_table=11
ttgctccaccatcgcccgggaatccgtttctgccagcccctggcacccgaccggctcctcctgcgcttaaaaattggccgccgggaacagcaaagctgccaggtaatctatgaagaccggggccttaaaacggcccccatgcatgcctatgcccgaacaccccgttacctttattaccaggctgagatcagcctctcccgtccctggcgctgccgttattttttccggctgcgggaaggggatggggatgaccgctatatctttgccggtggtaccggccaacagggccgcccctttacctatcagtggaccccggcagatatctttaccgttcccgactggatctacgacgccgtttcctatcaaatatttcccgatcgcttttacaacggcaacccggccaacgacccgccgggaaccaggccctggagcgaagcccctaccagggaaaacttcttcggcggcgacctggagggtatccaggcgaagataccctatctaaagtttctgggggtcaatgtcctgtggctcaaccccatttttgccgcctcctccaaccatcgctataacacccgcgattacctggccgtggacccggccctgggagataccgataccctgcgccgcctggtggcatccctccatggcgccggcatacgcatcatcctggatggtgtcttcaaccatacggggaccgatttctttgcttttaaagacgtggtcgcccggggagccggttccccgtataaggactggtactacttctatgacttcccggtacggagtgaaccccgggccaattatgcctgctggtgggatatccccagcctgcccaagctcaacgtcagaaaccccgaggttcgtaattaccttcttcacgtggcgacctactggctgtgggatgccggtaccgacggctggcgccttgacgtgcccaatgagatcgagccgcccttctggcgggagttttaccagcaggttaaagggaccaatccggaagcctacattgtcggcgagatctggcgcgacgcccgtttctggctgaacggccgttactttgacggggtgatgaattacctcttccgggacctggtccttgcatacttcgcccggaggctttttcccatttccaccctggatatgctcctgggcctggtgcgcctgcgctaccctgaggcggccaatttcgccctgttaaacctcctgggcagccatgacacggcgcgaattatcaccgccttccaggaagggttggccggcgttcccggacactccggcagctacgccgaggccgtagcccacctgcgaccggccctcatcctgcagctcacctatcccggtgcgcccctgatctactacggcgacgaggtaggcctcaccggcggcccggaccccgactgccgccggaccatgccctgggaaccccgggactgggaccgggatctcctgaacttttaccggtgcctgataaggttgcggcaccagttgcggcctttgcgacggggatttttccagcccctttttaccgacgaccaggccgaggtctacgcctatgcccggcgcctggagggagagaaggtaattataattctcaatgccagcgacctcccccagacggttaccctggcggcagccgtcgcgggactggctgaggatagtacctggcgggacggcctgagcaaccgcctcctggaggtgaagggcggccagatcagcctgcccctggacgccaattccggggccgttctctaccaggagtaa

SEQ ID NO: 776 - protein, 586 aa, Moorella thermoacetica ATCC 39073
MLHHRPGIRFCQPLAPDRLLLRLKIGRREQQSCQVIYEDRGLKTAPMHAYARTPRYLYYQAEISLSRPWRCRYFFRLREGDGDDRYIFAGGTGQQGRPFTYQWTPADIFTVPDWIYDAVSYQIFPDRFYNGNPANDPPGTRPWSEAPTRENFFGGDLEGIQAKIPYLKFLGVNVLWLNPIFAASSNHRYNTRDYLAVDPALGDTDTLRRLVASLHGAGIRIILDGVFNHTGTDFFAFKDVVARGAGSPYKDWYYFYDFPVRSEPRANYACWWDIPSLPKLNVRNPEVRNYLLHVATYWLWDAGTDGWRLDVPNEIEPPFWREFYQQVKGTNPEAYIVGEIWRDARFWLNGRYFDGVMNYLFRDLVLAYFARRLFPISTLDMLLGLVRLRYPEAANFALLNLLGSHDTARIITAFQEGLAGVPGHSGSYAEAVAHLRPALILQLTYPGAPLIYYGDEVGLTGGPDPDCRRTMPWEPRDWDRDLLNFYRCLIRLRHQLRPLRRGFFQPLFTDDQAEVYAYARRLEGEKVIIILNASDLPQTVTLAAAVAGLAEDSTWRDGLSNRLLEVKGGQISLPLDANSGAVLYQE

SEQ ID NO: 777 - DNA, 1419 bp, Thermotoga neapolitana
  CDS (1)..(1419): transl_table=11
atgtatcccataccaagttgggtatacgacagtgttgtgtaccagatattcccggacaggtttttcatcggcaaaggaaagaccgtcgaggacaaaaaagatctttatctgaaacgagggggaaccatcgaaaaatggggggttcctcctcgaaaacttcccggtgctcagcacgtgaaggtcttctacggaggagatctatggggaatagcagagaagatcgattacttagaagaactcggagttaacgcagtttacctcactcctatctttctttccgatacaaatcacaaatacgatacgatagattatttcaagatcgatccacagttcggaggaaaacgagcctttgtacaccttctgaaagttcttcacagcaggaacatcaaactcattctggacggtgtgttcaaccacgttggaagtcagcatccctggttcaaaaaggcaaggaagaaagatcctgaatacgtgaaccgtttctttctttacagagacaggcacagatcttggttcgacgtgggaagtttgcccgaactgaacgtggaagttgaagaggtgagagaatacatattgaaagtcgttcaacactacctggaagtgggtgtggacggctggaggctcgactgtggtcacgaccttggacctctggtcaacctgtggatcaacatgaaagtaaaggaattctcttctgaaaagtatcttgtgagcgagatatggacctacccggcaggatgggaaatggtcgatggattgatgaactacaatttcaggagccttgttttgagctatgtgaacggagaaacggattctatagggacagaactcgaaagggcttacagagaaacaaagaacatcttcgggtgctggaacatgctagacagccacgatactccaaggcttgcaacgacggtcccagtcaaagatctcagaaaactcgctatagtgcttcagttcacatatccgggcgttccgctcgtctattacggaacagagataggcctcacaggtggagaagatccggagtgtcgagccaccatggaatggaacagggaaaagtgggacatggagttgtttgagttttacaagaagatgatcaggttcaggagaaccgatcctggtttgaggtttggcgagttcatacttttgaaagaaaagccacttgccttcatgaggaaagccccgcatcctcttcaagacacgatcgttgtggtgaatcctgaagaggaaaaaaacgttgttctctcccttccggatggaaagatcatgaacgcaactcctcttttcgacatcttcaccggtgagaagttccatgtggatggaggagtcgtgaaggtgcccgttggaagaagatcgttcaggatcttaaagccgatcgacctcagagttggaaggtacagattgtacaagagagtgtga

SEQ ID NO: 778 - protein, 472 aa, Thermotoga neapolitana
MYPIPSWVYDSVVYQIFPDRFFIGKGKTVEDKKDLYLKRGGTIEKWGVPPRKLPGAQHVKVFYGGDLWGIAEKIDYLEELGVNAVYLTPIFLSDTNHKYDTIDYFKIDPQFGGKRAFVHLLKVLHSRNIKLILDGVFNHVGSQHPWFKKARKKDPEYVNRFFLYRDRHRSWFDVGSLPELNVEVEEVREYILKVVQHYLEVGVDGWRLDCGHDLGPLVNLWINMKVKEFSSEKYLVSEIWTYPAGWEMVDGLMNYNFRSLVLSYVNGETDSIGTELERAYRETKNIFGCWNMLDSHDTPRLATTVPVKDLRKLAIVLQFTYPGVPLVYYGTEIGLTGGEDPECRATMEWNREKWDMELFEFYKKMIRFRRTDPGLRFGEFILLKEKPLAFMRKAPHPLQDTIVVVNPEEEKNVVLSLPDGKIMNATPLFDIFTGEKFHVDGGVVKVPVGRRSFRILKPIDLRVGRYRLYKRV

SEQ ID NO: 779 - DNA, 1797 bp, Klebsiella oxytoca
  CDS (1)..(1797): transl_table=11
atgattacaattagttcattaagccactccgcaaagagtgccgatagctacgcttataataaagaaaccctacatattagatttcgcacagtcaaaggcgaggtcgcgaaagtctctctgtggatcggcgatccctatcaatgggaggaaggtggcctagatggtggaaaccttggcggcagcgacgcgcatggatggagcggcggcaacgaagttcacatggaaaaagagggacaaagcgagagctatgaccactggtttgccgcatttactccgtgcaaacgacgtagccgctatggttttatattatacggaaataacggggaaaaattattatttggtgaacgacgctgtgttgatataagtaaaccacctgtagcagagacagaactgagtaacttgtccaactttttttgcttcccttatatcaatccaggtgatgtactttctacgccagaatgggttaaaaaaacaatatggtatcagatctttcctgaacgattttgcaatggcgatccatcgatatcgccagaaaacgtacaaccgtggggaacgcctccagattcaaaaaactttatgggcggtgatttgcagggcattattaacaaacttgattatttgcaagatcttggcgttaacggtttatacctttgtcccatatttacggctaacgctagccataaatatgataccgtagattattttaacgttgatccccatttcggtggcaacgatcggtttaaagaattggtgcaaaaagctcaccaacgaggaatgaaggtcatgctggatgcagtgtttaatcatattggtaatcaatcaccattatggttagatgttgtaaaaaatggtgataaatcaccttacgcagactggttctggattaaaaaattcccggtatacccatctggtgataaaaatgagtgggatttccgtaatttcaattacgaaacctttggtaatgttattgaaatgcctaaacttaatactgaaaaccccgcttgtcgtgattatctgctgcaggtggcgagatattggattgaagaatttgatattgatggctggcgccttgatgttgccaatgaagtcgaccacgaattttggcgagctttccgtagaacggtaaaaagcataaaacctgattgttatattctcggtgaaatttggcatgaaggcatgccatggctgcgcggagaccagtttgactccttgatgaactatcctctaatgcaagcaactactgactatttcgctttacaagcatatgacaaaaaaacatttatagatattgttacccatgcctatctttgctatccacgtaacgttaatgaagttatgtttaatcttcttgaaagccatgatacttcacgtttattaagtctgtgtggtaatgataaacgtaaagcccggttagcctatctctttatgtttagtcaggtgggttctccttgtatttattacggtagcgaagttggtatgaatggcagcagagcaatgggatcggaagataatcgtaaatgtatgatatgggatgaacaaaagcaggatttagagtttaagtcatttattaaagatcttattctatggaggaaaaaacattccgaatggaatgatcctaaaatacactggaataatgtcgaccatccggcagttgtcgcttttagcagaggagaagtacatttcctccttaataatagtgatgaatctttagctattaattatcagggcagaacactatctctgacaccttttgggttttatattatcggtctggaccataaggacatcatatcatga

SEQ ID NO: 780 - protein, 598 aa, Klebsiella oxytoca
MITISSLSHSAKSADSYAYNKETLHIRFRTVKGEVAKVSLWIGDPYQWEEGGLDGGNLGGSDAHGWSGGNEVHMEKEGQSESYDHWFAAFTPCKRRSRYGFILYGNNGEKLLFGERRCVDISKPPVAETELSNLSNFFCFPYINPGDVLSTPEWVKKTIWYQIFPERFCNGDPSISPENVQPWGTPPDSKNFMGGDLQGIINKLDYLQDLGVNGLYLCPIFTANASHKYDTVDYFNVDPHFGGNDRFKELVQKAHQRGMKVMLDAVFNHIGNQSPLWLDVVKNGDKSPYADWFWIKKFPVYPSGDKNEWDFRNFNYETFGNVIEMPKLNTENPACRDYLLQVARYWIEEFDIDGWRLDVANEVDHEFWRAFRRTVKSIKPDCYILGEIWHEGMPWLRGDQFDSLMNYPLMQATTDYFALQAYDKKTFIDIVTHAYLCYPRNVNEVMFNLLESHDTSRLLSLCGNDKRKARLAYLFMFSQVGSPCIYYGSEVGMNGSRAMGSEDNRKCMIWDEQKQDLEFKSFIKDLILWRKKHSEWNDPKIHWNNVDHPAVVAFSRGEVHFLLNNSDESLAINYQGRTLSLTPFGFYIIGLDHKDIIS

SEQ ID NO: 781 - DNA, 1761 bp, Anoxybacillus flavithermus
  CDS (1)..(1761): transl_table=11
atgttaaaggaagctgtataccaccgtccaaccgatcagtttgcctatgcttatgacgacaaaacattgcacattcggttgcgaacgaagaaaagcgatgttcatgctgtgtcccttttgcatggtgatccgtattgttgggaagataggcaatggcagtttacaaaaacagagatgacaaaaagcggatcagatgccttgtttgactattggtgggtcgccatatcaccgccatatcgccgtctccgctacgggtttgagcttgtgtcaggaaacgagagatgcgtttatacggaaaaagggttttttcatgaagcacctattgatgatatcgcttattatttctgcttcccatttttaaatcgaatcgacgtatttcacgcgccaacatgggtgaaagataccgtttggtatcaaattttccctgagcggttcgcaaatggggatccgtccttgaacccgaaaggaacgatcccgtggggaagtgccgatccgactccgacgagcttttttggtggtgattttgctggcattatggagcggcttgattatttagtcgagctaggaattaacgggatttatttcactccgatttttaaagcatcgtccaatcataaatacgatacaattgattatttcgagattgatccacaatttggtgacaaaccaacatttaagcgacttgtcgagcgttgccaccaaaaaggcattcgcgttatgcttgatgcggtatttaatcatagtgggcattttttcgctccatttcaagatgtgctgaaacatggagaaaaatcaaaatataaagattggttccatattcacgagtttccattacaaaccgaaccgttaccgaactacgatacatttgccttcgtgccaactatgccaaaattaaatacggaaaatcaagaagtgaaacaatatctattagatgtagcaacatattggattcgcgaatttgatattgacggttggcgtttagatgtcgcaaatgaagtcgatcatcaattttggcgcgagtttcgtcaagcagtgaaagcggtgaaacaagacgtatatattcttggggaaatttggcacgatgcaatgccttggttacgcggcgatcagtttgatgcggtgatgaattatccatttacaaatggggtattgcgttattttgctaaaagcgaaatgaaagcaagcgaatttgctcattcgattacaaacgtgctccattcgtatccaaacaacgtaaatgaagtagcattccatttacttggcagccacgacactccgcgcattttaacggaatgtggggaaaataaggaaaaagtaaaactgatgtttactttccaattttcgttcacagggactccgtgcatttattacggcgatgaaattgggctaactggcggacaagacccgctttgccgcaaatgcatggtctgggaggaagaaaaacaagacctcgagttattcgcacacgtgcaaaaattaatttcattgcgccgcaagtaccgctctttgtctcgtggcgaactacactttctagaaacgaatgacgaaacaaaccatcttgtctatactaaaacatatgaacaagaaacggtaatattccttcttaacaatagcaaccgaaagcttgacatcacattgccgctttcggtaaaaagaaaaaagcttactgatttatggacaaataagcaatttgtgtcagaagaaaacgaatggaccgtaacgcttgcgccatacggatttcttatgttcttagttgaataa

SEQ ID NO: 782 - protein, 586 aa, Anoxybacillus flavithermus
MLKEAVYHRPTDQFAYAYDDKTLHIRLRTKKSDVHAVSLLHGDPYCWEDRQWQFTKTEMTKSGSDALFDYWWVAISPPYRRLRYGFELVSGNERCVYTEKGFFHEAPIDDIAYYFCFPFLNRIDVFHAPTWVKDTVWYQIFPERFANGDPSLNPKGTIPWGSADPTPTSFFGGDFAGIMERLDYLVELGINGIYFTPIFKASSNHKYDTIDYFEIDPQFGDKPTFKRLVERCHQKGIRVMLDAVFNHSGHFFAPFQDVLKHGEKSKYKDWFHIHEFPLQTEPLPNYDTFAFVPTMPKLNTENQEVKQYLLDVATYWIREFDIDGWRLDVANEVDHQFWREFRQAVKAVKQDVYILGEIWHDAMPWLRGDQFDAVMNYPFTNGVLRYFAKSEMKASEFAHSITNVLHSYPNNVNEVAFHLLGSHDTPRILTECGENKEKVKLMFTFQFSFTGTPCIYYGDEIGLTGGQDPLCRKCMVWEEEKQDLELFAHVQKLISLRRKYRSLSRGELHFLETNDETNHLVYTKTYEQETVIFLLNNSNRKLDITLPLSVKRKKLTDLWTNKQFVSEENEWTVTLAPYGFLMFLVE

SEQ ID NO: 783 - DNA, 1749 bp, Thermoactinomyces thalpophilus
  CDS (1)..(1749): transl_table=11
atgcttattgaagcactttttcacgaaacgagggttccctatgcctgtccggaaaatttgcattccctcagggtgcgactgcgtgccgggaaaggagaaatcgcccgctgtctcgtgctccacgcggatcgctatgaattactggattcctgttttcagcagacggaagcggaatggatggcctcggaccagcggtttgattattttgaagctttgctggagtgcactgcaaaacgcctgcaatatgtatttctcctggaaggaaaaaaaggagagcgggtttatttcggagaatcgggagtgtcaaaggaacggaaccgggcaggagttttccagtatgcctatatccatgaatcagccttgtttgtgaccccggagtgggccagggatgcggtggtttatcagatttttccggacaggtttgccaatggtgacaaggagaacgacccgccccggacggaagattggagcaaggatgcacggcccggaagggacagtttttacggcggtgacttggagggggtgatccattccctcccctatttgcgcaaactgggggttaatgcgctctatttcactcccatttttgcctccccatccaatcacaagtacgatacagcggattatctgagaattgatccccagtttggcaatctggacacgtttaagcgcctgatcagggaggctcaccggcacgggatgcgaatcattcttgatgcggtgttcaaccattcgggtgaccggttttttgcttttcgcgatgtactggaaaagggagcggactcgcaatacagagactggtttttcatcgagcagtttccggttgtgcaaacgccacagcccaactatgagacgtttgctgtcaatgttcctgtcatgccgaagctgcgcacggaaaacagggaggtaaaagaatatttgttccaggtcgtccgctactggacagaaatggggatcgacgggtggcggctggatgtggccaatgaggtggatcatgccttttggcgtgatttccgatcttttgtgaagatgctgaatccggaagccctcatcatcggcgaagtatggcataatgcggtaaaatggctggaaggggatcagtttgattcggtcatgaattatttgtttcgcgactgcgtttatcgtttttttgcagagcaaacatcagatgccagcgagtttgatgccgaattgaccacagcacgcatctcttatccggatcaggcgctgcaagtggcatggaatctgcttgattcccatgataccgagcgctttttgacctcttgcggtgaaaaggaagaacggttccgcctggccgtcttgtttcagatgacctatgtggggacgccgttgatttattacggggatgaaataggcatgaccggagagacagatcctgattgccgccggccgatgttgtgggataaagaggagcaaaatcaggcgcttttctcctattatcaacggctcatccggattcgccggagttgtgctccgttgcggagggggagtttccggacatggttggctgatccaggttcccctgtctatgcctttgtgcgctcatggcaaggggaaaatgcaggaattgtcctgaataacagcgacagctggcaaaatgtttccttgccgctggatacatgggcaaaaaggaattggaccgatttgttgacgggggaaaaaggccaggcatcaggaaaccggatggagttgattctttccccttatcagggaatagtgctggtttga

SEQ ID NO: 784 - protein, 582 aa, Thermoactinomyces thalpophilus
MLIEALFHETRVPYACPENLHSLRVRLRAGKGEIARCLVLHADRYELLDSCFQQTEAEWMASDQRFDYFEALLECTAKRLQYVFLLEGKKGERVYFGESGVSKERNRAGVFQYAYIHESALFVTPEWARDAVVYQIFPDRFANGDKENDPPRTEDWSKDARPGRDSFYGGDLEGVIHSLPYLRKLGVNALYFTPIFASPSNHKYDTADYLRIDPQFGNLDTFKRLIREAHRHGMRIILDAVFNHSGDRFFAFRDVLEKGADSQYRDWFFIEQFPVVQTPQPNYETFAVNVPVMPKLRTENREVKEYLFQVVRYWTEMGIDGWRLDVANEVDHAFWRDFRSFVKMLNPEALIIGEVWHNAVKWLEGDQFDSVMNYLFRDCVYRFFAEQTSDASEFDAELTTARISYPDQALQVAWNLLDSHDTERFLTSCGEKEERFRLAVLFQMTYVGTPLIYYGDEIGMTGETDPDCRRPMLWDKEEQNQALFSYYQRLIRIRRSCAPLRRGSFRTWLADPGSPVYAFVRSWQGENAGIVLNNSDSWQNVSLPLDTWAKRNWTDLLTGEKGQASGNRMELILSPYQGIVLV

SEQ ID NO: 785 - DNA, 1962 bp, Paenibacillus sp
  CDS (1)..(1962): transl_table=11
atgtttctggaagctgtgtatcaccgtccgcgcaaaaactggtcctatgcgtacaacggcaccaccgttcatcttcggatccgcaccaagaaagacgacatgaccgccgtctatgctctcgccggtgacaagtacatgtgggaccacacgatggagtatgtcccgatgaccaagctggcgacagacgagctgttcgactactgggaatgcgaggtgaccccgccgtaccgaagagtgaaatacgggtttctgctgcagcagggtcatgagaagcgctggatgaccgagtatgattttctgaccgagccgccggccaatcccgaccgactgtttgagtacccgttcatcaaccctgtcgatgtgttccagccgccggcatgggtgaaggatgccatcttctatcaaattttccctgaacggtttgccaacggggatacccgcaatgatcccgaaggcacgctgccatgggggagtgccgatccgacgccaagctgcttctttggcggtgatctgcaaggcgtcatcgaccacctcgatcatctgagcaagctgggcgtgaacgccgtatacttcaccccgctctttaaggcgaccaccaaccataagtacgatacggaggattattttcagattgacccgcagttcggggacaaggatacgctgaagaagctcgtcgatctgtgccatgagcgcggaattcgcgtcctgctggacgccgtgttcaaccattccggccgaaccttccctcccttcgttgatgtcctcaagaacggggagaagtccaaatacaaggactggttccatatccgctccctgccgcttgaggtggtggacggcattccgacgtatgatacctttgcctttgaaccgctgatgcccaagctcaataccgagcatccggaagtgaaggaatacttgctgaaggccgcggaatactggattcgcgaaacggggatcgacggctggcggctcgatgttgccaatgaggtgagccaccagttctggcgcgagtttcgccgggtggtgaagcaagcgaaccccgatgcctatattctgggcgatgtatggcatgaatcgtccatctggctcgagggcgaccagttcgatgcggtgatgaactatccgttcaccaacgccgtccttgatttcttcattcatcaaatcgccgatgccgagaagttctccttcatgctcggcaagcagcttgccgggtatccgcgccaggccagcgaagtcatgttcaacctgctggacagccatgacaccgccagattgctgacccaagcggatggcgacaagcggaagatgaagctggcggtgctgttccagttcacctacttcggcaccccgtgcatctattatggggacgaggtcggccttgatggcgggcatgacccgggatgccgcaaatgtatggaatgggacgagacgaagcatgacaaggatctgttcgcgttctaccagacggtcatccggctccgccaagctcatgctgctctgcgcaccggcaccttcaagttcctcacggccgagaagaacagccggcagattgcttacctgcgtgaggacgaccaagatacgatcttggtcgtcatgaacaacgacaaggcgggccacacgcttacgctgcctgtccggcatgcacagtggacccatctgtggaacgacgatgtcctgaccgctgctcacggacagttgaccgtgaagctcccggcttacggctttgccgtgctgaaggcctcatccgattggtcatcatgggggcgccctccgttcactggcgaacacgccagcccgagcaagcggggcgcctctttttgtcgctccccctcctttcccttgacatcatcacattggcttgacccggtatcaacgttatcatgctcatgggttcagttatttagtaaattagtaaattataaatttagtgaacaattgagctgcatgtcattgaaatcatga

SEQ ID NO: 786 - protein, 653 aa, Paenibacillus sp
MFLEAVYHRPRKNWSYAYNGTTVHLRIRTKKDDMTAVYALAGDKYMWDHTMEYVPMTKLATDELFDYWECEVTPPYRRVKYGFLLQQGHEKRWMTEYDFLTEPPANPDRLFEYPFINPVDVFQPPAWVKDAIFYQIFPERFANGDTRNDPEGTLPWGSADPTPSCFFGGDLQGVIDHLDHLSKLGVNAVYFTPLFKATTNHKYDTEDYFQIDPQFGDKDTLKKLVDLCHERGIRVLLDAVFNHSGRTFPPFVDVLKNGEKSKYKDWFHIRSLPLEVVDGIPTYDTFAFEPLMPKLNTEHPEVKEYLLKAAEYWIRETGIDGWRLDVANEVSHQFWREFRRVVKQANPDAYILGDVWHESSIWLEGDQFDAVMNYPFTNAVLDFFIHQIADAEKFSFMLGKQLAGYPRQASEVMFNLLDSHDTARLLTQADGDKRKMKLAVLFQFTYFGTPCIYYGDEVGLDGGHDPGCRKCMEWDETKHDKDLFAFYQTVIRLRQAHAALRTGTFKFLTAEKNSRQIAYLREDDQDTILVVMNNDKAGHTLTLPVRHAQWTHLWNDDVLTAAHGQLTVKLPAYGFAVLKASSDWSSWGRPPFTGEHASPSKRGASFCRSPSFPLTSSHWLDPVSTLSCSWVQLFSKLVNYKFSEQLSCMSLKS

SEQ ID NO: 787 - DNA, 1767 bp, Bacillus stearothermophilus
  CDS (1)..(1767): transl_table=11
atgaggaaagaagccatccaccaccgctcaaccgaccatttcgcttatgcttatgacagcgagacgctccatctccggcttcaaacaaagaaacatgatgtcgaccacgtcgagctgctttttggcgacccgtacgaatggcacgatggcgcctggcagtttcaaacgatgccgatgcggaaaacgggaagcgacgggttgtttgactattggctcgccgaagtcaaaccgccatatcgacggctgcgctatgggtttgtgcttcgagctggggacgagaaactggtctatacggaaaaaggattttaccatgaagctccgagcgacgacaccgcttactacttttgcttcccctttcttcatcgggtcgacctattccaagcgccggactgggtaaaagacacagtatggtatcaaattttccccgagcggttcgccaacggcaacccggccatcagtccgaaaggggcgcggccgtggggaagcgaggacccgacgccgacgagctttttcggcggcgacttgcaaggaatcatcgatcaccttgactatttggctgatctcggcatcaccggcatttacttgacgccgattttccgcgcgccgtcgaatcataaatacgacaccgctgattattttgaaatcgacccgcactttggggacaaagagacgttgaaaacacttgtcaagcgctgccatgaaaaagggatccgcgtcatgctcgatgcagtcttcaatcattgcggctatgagtttgccccgtttcaagatgtgttaaaaaacggtgcagcgtctaggtataaagattggttccatattcgcgagtttccgctccaaacggagccgcgcccgaattacgacacatttgcgttcgtgccgcaaatgcccaaactcaataccgcccatccggaagtgaagcgctacttgcttgatgtcgcgacgtactggattcgcgagtttgatattgacggctggcggctcgatgtggcaaacgaaatcgatcaccaattttggcgcgaattccgtcaggcggtgaaggcgctaaagcccgatgtgtacattctcggcgagatttggcatgatgccatgccgtggctgcgcggcgaccaatttgacgccgtcatgaactacccgttcacggacggagcgcttcgctttttcgcgaaagaggaaatcagcgcccgccagtttgccgatatcatggtccggttgcttcattcgtatccgaaacatgtgaacgaagcggcgtttaacttgcttggcagccatgatacaccaaggctgctcactgtttgcggcggcgacgtccgcaaagcgaagttgttgtttttgttccagctcacgttcactggttcgccgtgtatttactatggcgatgagatcggcatgacgggtggaaacgatccggaatgccggaaatgtatggtgtgggatacagagaagcaaaacaaagaactgtatgaacatgtcaagcaactgatcgctcttcgcaggcaatatcgggcgcttcgacgcggcgatgtcgcttttctcgccgccgatgatgaagcgaaccatcttgtttatgaaaaaacggatggcaatgaaacggtcatgatcatcatcaaccggagcaacgaagcagcagaaattcccatgccgatcgatgcgcgtggaaaatggctggtcaaccttctgacaggggagcggttcgctgcagaggcggaaacactttgcgtctccttgccgccgtacgggtttgtgctttacgcggtcgaaagctggtaa

SEQ ID NO: 788 - protein, 588 aa, Bacillus stearothermophilus
MRKEAIHHRSTDHFAYAYDSETLHLRLQTKKHDVDHVELLFGDPYEWHDGAWQFQTMPMRKTGSDGLFDYWLAEVKPPYRRLRYGFVLRAGDEKLVYTEKGFYHEAPSDDTAYYFCFPFLHRVDLFQAPDWVKDTVWYQIFPERFANGNPAISPKGARPWGSEDPTPTSFFGGDLQGIIDHLDYLADLGITGIYLTPIFRAPSNHKYDTADYFEIDPHFGDKETLKTLVKRCHEKGIRVMLDAVFNHCGYEFAPFQDVLKNGAASRYKDWFHIREFPLQTEPRPNYDTFAFVPQMPKLNTAHPEVKRYLLDVATYWIREFDIDGWRLDVANEIDHQFWREFRQAVKALKPDVYILGEIWHDAMPWLRGDQFDAVMNYPFTDGALRFFAKEEISARQFADIMVRLLHSYPKHVNEAAFNLLGSHDTPRLLTVCGGDVRKAKLLFLFQLTFTGSPCIYYGDEIGMTGGNDPECRKCMVWDTEKQNKELYEHVKQLIALRRQYRALRRGDVAFLAADDEANHLVYEKTDGNETVMIIINRSNEAAEIPMPIDARGKWLVNLLTGERFAAEAETLCVSLPPYGFVLYAVESW

SEQ ID NO: 789 - DNA, 1737 bp, Alicyclobacillus acidocaldarius
  CDS (1)..(1737): transl_table=11
atggaacttgtgtggcagcatcgttgggcggcagacgcttacccgcttgacttgtcaaccatggttcttgtgttgcgcgttgcgcgatgcacacccgcacagcgggtgcgggtgcactttggagatcggtacgaacctgactttcagaattcaagtgaggctcgaagatacggatcggacggaacatttgactggtttacgtgtcgagttgccgcaccgacgcgaagactgaagtatgcatttgaagtgttatcctcaactggacgggctgtgtacctgggtgagggcgggctcgcggatacattggatgctgtccagccctttcaatatccgtacattcatccatctcgggttctcgctgtcccagattgggtggggcatgcggtggcttatcaaatatttcctgatcggtttgctgtgggtgaacaacagttggtacgtccgacggatccatgggacgcgcgtccaacccctgatagtgtatttggtgggaacctgcgagggattgtggacaaactcccgtatctgagcgatctcggcgtgaacctgatgtacctcacgcctatcttccaggctccatcgaaccacaaatacgacacgcaggactattttgccgtagaccccgcattcggtaccttgggcgatctgcaattgctcgtacgagaagctcatcgcctcgggattcgcgtggttctcgacgcagtgttcaaccattcggggtttcaatttgccccctttcaggacgtcattgcgcgcggtacggcgtctccctattggtcttggttcttcgtgcaaggggaccgcgttgacgtcgaatccgtcaattatgagactttcgcaacgcgcctcagacatatgccaaaactgaacttggcagagcctgctgccgaagaatactttctgcaagtggccaaacactatgttctcgagtgcgatatcgacggatggcgttttgacgtcgccaacgaaatcgatccccacttttggtcacggttgcgatcagaactgcgcgccttgaaacctgatatcttgttgataggagaaatatggcatgacagcctcccttggctgatgggcgatgccttcgatggcgtgatgaattatccgcttcgagagcttgtcatgcgctatgccatggacgaatccatagatgaacctgctttcgcagaagcgtgggtacgcctctatctgcagtacccgcgtccggcatggcgcgcgatgtggaatctgttgggcagtcatgatactgaacgcgcgcttacgcgcgcacgcggtcatgttccctctgttgtgttggcgtttgcaatgcttttcacgctacccggaattcccatggtgtattatggggacgagatcggcatggaaggtggaaccgatccggattgccgtcggggcatgatctgggacgcgaacttatggcagcttgatcttcgcgaagccgtgcggcaactcgcatggctcaagcgaacccatcccgcgcttgcaggagatacaatggagattcgcgatgcgaactctggcgtgctgcattatgtacggctaaacggcacaggtccgcatcttcacattgctgtttgcaaacgtcgagacttcggcgcggaagtggactccccactattcgcgtgggatgtgccatctcggacatcgggcgaggaacgaaagatcctgatatgggaatgcgattcaactgaggggtgtgggcatgattcacgagcagacggatttcacaaccagtga

SEQ ID NO: 790 - protein, 578 aa, Alicyclobacillus acidocaldarius
MELVWQHRWAADAYPLDLSTMVLVLRVARCTPAQRVRVHFGDRYEPDFQNSSEARRYGSDGTFDWFTCRVAAPTRRLKYAFEVLSSTGRAVYLGEGGLADTLDAVQPFQYPYIHPSRVLAVPDWVGHAVAYQIFPDRFAVGEQQLVRPTDPWDARPTPDSVFGGNLRGIVDKLPYLSDLGVNLMYLTPIFQAPSNHKYDTQDYFAVDPAFGTLGDLQLLVREAHRLGIRVVLDAVFNHSGFQFAPFQDVIARGTASPYWSWFFVQGDRVDVESVNYETFATRLRHMPKLNLAEPAAEEYFLQVAKHYVLECDIDGWRFDVANEIDPHFWSRLRSELRALKPDILLIGEIWHDSLPWLMGDAFDGVMNYPLRELVMRYAMDESIDEPAFAEAWVRLYLQYPRPAWRAMWNLLGSHDTERALTRARGHVPSVVLAFAMLFTLPGIPMVYYGDEIGMEGGTDPDCRRGMIWDANLWQLDLREAVRQLAWLKRTHPALAGDTMEIRDANSGVLHYVRLNGTGPHLHIAVCKRRDFGAEVDSPLFAWDVPSRTSGEERKILIWECDSTEGCGHDSRADGFHNQ

SEQ ID NO: 791 - DNA, 1761 bp, Bacillus acidopullulyticus
  CDS (1)..(1761): transl_table=11
atgtttagagaagcaatttatcaccgtcctaaagataattatgcatatgcttgcgcaaatggagaattacatatcagaatcagaacgaaaaaagacgatatgaaagaggtaacacttgtttacggagacacttatgaatttgatgacaataaatggacctattcaacagcccatatgaaaaaaaccggctccgaccaattgtttgattactggctcgcttctgtcactccgcgatataagagattgcgctatgggtttattgtaaatgaccgcaaagactcgacctgttttactgaaaaagggttttacccggagcccccagtaaatgacatttcctattatttcagctttccttatgtgaatcaggccgatattttccaggcacccgaatgggtaaaggacaccgtctggtatcaaattttccctgaacgctttgccaatggaaacaaagacaacgaccctgatggcacccttccatggggcagccgtgaaccggaaattgacaacttttttggcggagatttggaaggagtcattgaacatattgactatctcaaagaattgggcattggcggtatatactttacccctatatttaaggcacactccaaccataaatacgatacgattgattacatggaaatagatccgcaattcgggacaaaagaaacattaaaaaaattgattgatgtctgccataaaaatggaataaaagtgatgcttgatgctgtgtttaatcatagcggtgttttttttccaccatttcaggatgtagtggaaaaaggtaagaattccaagtaccaagactggttccacatccgggagtttccactcgtaatggagccaaggccaaattatgataccttcggctttacgtcttccatgccaaagttcaagacagaaaaccctgaagtgaaggaatatttactagaggttggccggtattgggtaagggaatttgatattgacggctggcgtttagatgtggcaaatgaagtgagccacgccttttggcgtgaattccgcagggaagtgaaagccatcaagcccgacttgtatatccttggggaaatttggcacgactccttgccttggctgcggggtgatcaatttgatgctgtgatgaattatcctttatccactaatattgtaaatctttttgccaatcaatccgtttcggtaaaagagtttgtagaaaatatgtcccatgttatccatatgtatcctgacactgttaacgaagctgcgttcaaccttgttggcagccacgatacaccgagaatattaacacagtgcggagaggatgtagaacgcttaaagcaagtgtttgtcttattgttaacattcataggcaccccctgcatttattacggggatgaaatcggcttaaccggcggacaggatcccggctgccggaaatgcatggagtggaatccagaccaacaaaaccgtgaacttcttcagcacgtcaggaaattaatacaattacgcagcgaaaatcctttgctcgccaatgagggagagctgacttttgtcccaccgaaaaatgaggaagatccgtgtcttgcttatacaaaatccaatgaggaaaaaacgattatgattattataaataaaagtaaaaactcagtggagtacccactttcatttgacgcagctgaacaaacagtaaaaaatctttggaatcaggaacagttgattttacaaaatggccaaacactggaactgaaggcaaatgactttaaaatattagaattttaa

SEQ ID NO: 792 - protein, 586 aa, Bacillus acidopullulyticus
MFREAIYHRPKDNYAYACANGELHIRIRTKKDDMKEVTLVYGDTYEFDDNKWTYSTAHMKKTGSDQLFDYWLASVTPRYKRLRYGFIVNDRKDSTCFTEKGFYPEPPVNDISYYFSFPYVNQADIFQAPEWVKDTVWYQIFPERFANGNKDNDPDGTLPWGSREPEIDNFFGGDLEGVIEHIDYLKELGIGGIYFTPIFKAHSNHKYDTIDYMEIDPQFGTKETLKKLIDVCHKNGIKVMLDAVFNHSGVFFPPFQDVVEKGKNSKYQDWFHIREFPLVMEPRPNYDTFGFTSSMPKFKTENPEVKEYLLEVGRYWVREFDIDGWRLDVANEVSHAFWREFRREVKAIKPDLYILGEIWHDSLPWLRGDQFDAVMNYPLSTNIVNLFANQSVSVKEFVENMSHVIHMYPDTVNEAAFNLVGSHDTPRILTQCGEDVERLKQVFVLLLTFIGTPCIYYGDEIGLTGGQDPGCRKCMEWNPDQQNRELLQHVRKLIQLRSENPLLANEGELTFVPPKNEEDPCLAYTKSNEEKTIMIIINKSKNSVEYPLSFDAAEQTVKNLWNQEQLILQNGQTLELKANDFKILEF

SEQ ID NO: 793 - DNA, 1776 bp, Bacillus sphaericus
  CDS (1)..(1776): transl_table=11
atgattatgctggaagccgtttaccaccggatgggacaaaactggtcctatgcctacaatgattcgaccttgcatatccgcatccgcaccaagcgggacaatgtcccgcgcatcgacctgcactgcggcgagaagtacgatccggagaagtacaaggaaaccattcccatggagcgtatggcttctgacggactgtttgattattggcaagccgccgtgcagcccagataccgtagattagtttattacttcgcgctgcattccgacaacggcgatgccgtttactttatggagaagggattctttgatcagccgcccaaggtgatgtatgaaggattgttcgacttcccttatctgaatcggcaggatgtgcacacgcctccggcatgggttaaggaagcgatattctatcagattttccccgagcgcttcgcgaacggcgatccgtccaacgatcccgaaggcgtgcaggaatggggaggtacgcccagcgccggcaatttcttcggcggggatttgcaaggcgtgatcgatcatctggactatctaagcgatctgggcgttaatgctttgtatttcaaccccctattcgcggccaccaccaaccataaatacgatacggcggactatatgaagatcgacccccaattcggcacgaacgaaaagctcaaggagctggtcgatgcctgccatgcccggggcatgcgcgtgctgctggacgccgtgttcaaccactgcggccatacgtttccgccgttcgtggacgtgttgaacaacggtctgaattcgcgttacgcggattggttccatgttcgggaatggcctctgcgggtcgttgacgggattccgacctacgatacgttcgcattcgaaccaatcatgcccaagctcaataccggcaatgaagaagtgaaggcttacctgttgaatgtcggccgttactggctggaggagatggggctggacggctggcggctggatgtcgccaatgaggtggaccatcaattctggcgggaattccggagcgagatcaaacggatcaatccttcggcctatatcttaggcgagattatgcatgattccatgccgtggctgcaaggcgaccaattcgacgcggtcatgaattatcccttcacgaacatcctgctgaacttcttcgcccgcaggctgacgaacgcggccgaattcgcccaggcgatcggcacgcagctcgccggttatccgcagcaggttacggaagtgtcattcaatctgctcggcagccatgacacgacgaggctattgacgttgtgcagcggcaatgtggagcgcatgaagctggcgaccttattccagctgacctatcaggggacgccatgcatctattacggcgacgagatcggcatggacggcgagtatgaccccctcaaccgcaagtgcatggaatgggacaagagcaagcagaatacggagctgcttgcgttcttccggagcatgatcagcctgcgcaaggctcaccctgcgctgcgcggaagcggactgcgcttcctgccggtgctggagcacccgcagttgctggtctatgagcgctgggacgataatgagcgattcctcatcatgctgaataatgaggatgctcccgtgaacgttgttatcccggcagctcagcccggcgcttcttggcgcaccgtgaacggcgagccatgcgcagtagtcgaggaaagttcgatacaggcggctctccctccttacggttatgccatactgcatgcgcctatagcaggaacggctgagtaa

SEQ ID NO: 794 - protein, 591 aa, Bacillus sphaericus
MIMLEAVYHRMGQNWSYAYNDSTLHIRIRTKRDNVPRIDLHCGEKYDPEKYKETIPMERMASDGLFDYWQAAVQPRYRRLVYYFALHSDNGDAVYFMEKGFFDQPPKVMYEGLFDFPYLNRQDVHTPPAWVKEAIFYQIFPERFANGDPSNDPEGVQEWGGTPSAGNFFGGDLQGVIDHLDYLSDLGVNALYFNPLFAATTNHKYDTADYMKIDPQFGTNEKLKELVDACHARGMRVLLDAVFNHCGHTFPPFVDVLNNGLNSRYADWFHVREWPLRVVDGIPTYDTFAFEPIMPKLNTGNEEVKAYLLNVGRYWLEEMGLDGWRLDVANEVDHQFWREFRSEIKRINPSAYILGEIMHDSMPWLQGDQFDAVMNYPFTNILLNFFARRLTNAAEFAQAIGTQLAGYPQQVTEVSFNLLGSHDTTRLLTLCSGNVERMKLATLFQLTYQGTPCIYYGDEIGMDGEYDPLNRKCMEWDKSKQNTELLAFFRSMISLRKAHPALRGSGLRFLPVLEHPQLLVYERWDDNERFLIMLNNEDAPVNVVIPAAQPGASWRTVNGEPCAVVEESSIQAALPPYGYAILHAPIAGTAE

SEQ ID NO: 795 - DNA, 1725 bp, Thermoanaerobacter ethanolicus
  CDS (1)..(1725): transl_table=11
atgataaaagaagctatattccataaaagcgatgtgccttacgcatatccactgaatgaaaatcaattaaagatagtactaaggactgctgtatttgatgtagatagggtgtatgttttatacaaagacagatacgattggctgggaaaattcaaaataaaaccaatggtattaactcataccaacgagttatttgattattatgagactactttagagcttaataaaaaatttgtgtattttttctatttggtatctgatgggggcgagaagttatattatacagaagcaggattttacaaaaaaaggccagaaaatcatttttggggatttttccattacccgtatataggagaaaaggatgtcttttttgctccagagtggacaagcgattgcatggtgtatcagatatttcctgaaaggtttaataacggtgataaatcaaatgaccctgaaaatgtaaagccctggggtgaaaaacctactgcagattctttctttggaggagatttgcaaggaataatagataaaatagattatttaaaggatttgggtataaatgccatttatttaacccccatatttttatcgcattccacccacaaatatgatactactgattattatacaattgacccccactttggtgatacgcaaaaagcgagagaacttgtgcaaaaatgtcatgacaatggcataaaagttatatttgatgccgtttttaatcactgcggatatgacttttttgcatttcaggatgttattaaaaatggtaaaaaatcaaaatactgggattggtttaatatatacgaatggccaattaaaactcatggaaaaccttcctatgaagcttttgcagatactgtatggagaatgccaaaacttatgacaaaaaatccagaagtacagaagtatttattggaagtagcggaatattggattaaagaagtggacatagacggctggaggctggatgttgctaatgagatagaccaccatttttggagaaagtttagagaagttgtaaaggcagctaaaccggaggccataattgtaggagaggtttggcatgatgcttctccttggcttagaggggatcagtttgacagtgtaatgaactatccttttagaaatgcggttgtggacttttttgcaaaaaggaaaataagtgcttctcgctttaatacaatgattacagagcaacttatgaggcatatggatagtgtaaatagggttatgtttaatttaataggaagtcatgatactgagaggtttttgactttagctaatggcatggttgcgagaatgaagttagcattagtgtttcaatttacctttgttggaatcccatatatttactatggggacgaggtaggaatggtgggagattatgaccctgattgcagaagatgcatgatatgggaggaggaaaagcaaaataaaagtatttttaatttctataaaaagttgatttctataaggagagaaaatgaggagctcaaatacggaagtttctgtactttatatgctataggaagagtgtttgcttttaagagggaatacaaaggtaaatcaataattgttgtactaaataacagtagcaagcaggaagtgatatttttgaatgaagtagaaggaaaagaagatattttaaagatgaaggaattaaaaagaagtggaaatctcctttacttgcaacctaactctgcctatattttaaagtaa

SEQ ID NO: 796 - protein, 574 aa, Thermoanaerobacter ethanolicus
MIKEAIFHKSDVPYAYPLNENQLKIVLRTAVFDVDRVYVLYKDRYDWLGKFKIKPMVLTHTNELFDYYETTLELNKKFVYFFYLVSDGGEKLYYTEAGFYKKRPENHFWGFFHYPYIGEKDVFFAPEWTSDCMVYQIFPERFNNGDKSNDPENVKPWGEKPTADSFFGGDLQGIIDKIDYLKDLGINAIYLTPIFLSHSTHKYDTTDYYTIDPHFGDTQKARELVQKCHDNGIKVIFDAVFNHCGYDFFAFQDVIKNGKKSKYWDWFNIYEWPIKTHGKPSYEAFADTVWRMPKLMTKNPEVQKYLLEVAEYWIKEVDIDGWRLDVANEIDHHFWRKFREVVKAAKPEAIIVGEVWHDASPWLRGDQFDSVMNYPFRNAVVDFFAKRKISASRFNTMITEQLMRHMDSVNRVMFNLIGSHDTERFLTLANGMVARMKLALVFQFTFVGIPYIYYGDEVGMVGDYDPDCRRCMIWEEEKQNKSIFNFYKKLISIRRENEELKYGSFCTLYAIGRVFAFKREYKGKSIIVVLNNSSKQEVIFLNEVEGKEDILKMKELKRSGNLLYLQPNSAYILK

SEQ ID NO: 797 - DNA, 2001 bp, Thermoactinomyces vulgaris
  CDS (1)..(2001): transl_table=11
atgatcaaattattaaagccgatgtctttgtccatcctccttgtcttcattctctcattttcttttccatttcccacggcaaaggcggccgccaatgacaacaatgtggagtggaatggattgtttcatgatcaaggcccgctttttgacaacgcgccggagcccacttcaacccagagtgtcacgcttaaactgcgaaccttcaaaggagatattaccagcgccaatatcaagtattgggatactgccgacaatgcctttcactgggtgcccatggtttgggattccaatgacccgacaggcacgtttgattactggaaagggacgatcccggcaagcccatcgatcaagtattaccgtttccaaattaacgatggcacaagcacggcctggtacaacggcaatggcccttcttccaccgaaccgaatgccgatgatttttatattattcccaatttcaaaacgccggactggctgaaaaacggcgtaatgtaccagatctttccggatcgtttctacaatggcgattcttcaaatgatgtccagacaggctcctatacctataacggcaccccaacggagaaaaaagcatggggcagcagcgtttacgctgatccggggtacgacaatagtttggtcttttttggcggagacctggcgggaatcgatcaaaaactgggctatatcaaaaagactctcggcgcgaacatcctctatctgaatcccatcttcaaggcgccaaccaaccacaaatacgacacccaggactacatggcggttgatcccgcgtttggcgacaattccaccttgcaaacgctgatcaacgacatacacagcaccgcgaacggccctaaagggtaccttattttggacggggtgttcaaccacacgggagacagccatccgtggtttgacaaatacaataatttttcgtctcagggagcatacgagtcacaatccagcccatggtacaactactatactttctacacatggcccgattcatacgcttcttttctcggattcaacagtttgcccaaactaaactacggcaacagcggttcagccgtacggggcgtaatctacaacaacagcaattcggtggctaaaacctatttaaacccgccttattctgtcgatggttggcggctcgatgcagcacaatatgttgacgcaaatggcaacaatggaagtgacgtgaccaaccaccagatttggagcgaatttcggaatgccgtcaagggagtgaattcaaacgccgcaatcatcggggagtattggggcaacgccaatccatggacggcccagggaaaccagtgggacgcagccaccaactttgatggcttcacccagcctgtttctgaatggattaccggcaaagactaccaaaacaattcggcttcgatcagcaccacacagtttgacagttggcttagggggacacgggccaactaccctaccaatgtccaacagtccatgatgaacttcctttccaatcatgacatcacccgctttgccacacgttccggcggagatctttggaaaacctacttggccctgatctttcagatgacttatgtgggcactccgaccatttactatggggacgaatacggcatgcagggaggcgcggaccccgacaaccgccggtcctttgattggtcacaagccactccctccaatagcgcggtggccctgacccaaaagctgatcaccattcgcaaccaataccctgctttaagaaccggttcctttatgacattaatcacggacgacaccaacaaaatttattcttatgggcgttttgacaacgtcaaccgaatcgccgtcgtgctaaacaatgactccgtcagccatacggtcaacgtgccggtttggcaactcagcatgccaaatggcagcactgtcacggacaaaattaccggccatagttacaccgtacaaaacggcatggttaccgttgccgttgacgggcactacggcgctgtcttggcacaataa

SEQ ID NO: 798 - protein, 666 aa, Thermoactinomyces vulgaris
MIKLLKPMSLSILLVFILSFSFPFPTAKAAANDNNVEWNGLFHDQGPLFDNAPEPTSTQSVTLKLRTFKGDITSANIKYWDTADNAFHWVPMVWDSNDPTGTFDYWKGTIPASPSIKYYRFQINDGTSTAWYNGNGPSSTEPNADDFYIIPNFKTPDWLKNGVMYQIFPDRFYNGDSSNDVQTGSYTYNGTPTEKKAWGSSVYADPGYDNSLVFFGGDLAGIDQKLGYIKKTLGANILYLNPIFKAPTNHKYDTQDYMAVDPAFGDNSTLQTLINDIHSTANGPKGYLILDGVFNHTGDSHPWFDKYNNFSSQGAYESQSSPWYNYYTFYTWPDSYASFLGFNSLPKLNYGNSGSAVRGVIYNNSNSVAKTYLNPPYSVDGWRLDAAQYVDANGNNGSDVTNHQIWSEFRNAVKGVNSNAAIIGEYWGNANPWTAQGNQWDAATNFDGFTQPVSEWITGKDYQNNSASISTTQFDSWLRGTRANYPTNVQQSMMNFLSNHDITRFATRSGGDLWKTYLALIFQMTYVGTPTIYYGDEYGMQGGADPDNRRSFDWSQATPSNSAVALTQKLITIRNQYPALRTGSFMTLITDDTNKIYSYGRFDNVNRIAVVLNNDSVSHTVNVPVWQLSMPNGSTVTDKITGHSYTVQNGMVTVAVDGHYGAVLAQ

SEQ ID NO: 799 - DNA, 1758 bp, Thermoactinomyces vulgaris
  CDS (1)..(1758): transl_table=11
atgctgttggaagcgatttttcatgaagcgaaaggaagctatgcttacccgatttcggaaacgcaactgcgggtgagattgcgggcgaaaaaaggggacgtggtgagatgcgaggtgctctatgcggaccgctatgcttcgccggaggaagaactggcacatgcacttgcgggcaaagcagggtccgatgagcgatttgattattttgaggctttactggaatgttccaccaaacgggtgaaatacgtgtttttgttgacaggcccacaaggggaggctgtttattttggcgagaccggtttttccgccgaacggtctaaagcgggggtgttccaatatgcttacatccaccggagcgaagtgtttacgacaccggaatgggcaaaggaggcggtgatctaccagatctttcccgaacgttttgccaatggggatcccagcaatgatccgccgggaacggaacaatgggccaaagacgccagacctcggcacgacagtttttacggcggagatttaaagggggtgatcgaccgtttgccatatttggaggagttgggagtgacggcgctttattttactcccatttttgcttcgccgtcccatcacaaatatgatacagctgattatttggcgattgatccgcaatttggggatttgcccacctttcggcgtttggtggatgaagctcaccggcgcgggatcaaaatcattttggatgccgtgtttaaccatgccggagatcagttttttgcgtttcgggatgttctgcaaaagggagaacagtcgcgatataaggattggtttttcatcgaggattttcccgtttccaagacgtcaagaaccaattatgaaacctttgccgtccaagtgccggccatgcccaaattgcggacggaaaatccggaagtgaaggaatatttgtttgatgtcgcgcgattttggatggagcaggggatcgacggatggagactggatgtggccaatgaggtggatcacgccttttggcgcgagtttcgccgccttgtcaaatccctcaatcccgacgccttgattgtcggagagatttggcatgacgcttccggctggctgatgggagaccaatttgattcggtgatgaattatttgtttcgcgagagtgtgatccgtttttttgccacgggggagatccatgccgaaagatttgacgccgaacttacccgggccaggatgctttatccggaacaggcggcacaagggttatggaacctcctcgactcacacgatacggaacgttttttgacatcgtgtggggggaatgaggcgaaattccgcctggctgttttgtttcagatgacatacctggggacgccgctgatttattacggtgatgagatcgggatggccggagcgacggacccggattgccggcgcccgatgatatgggaggaaaaagagcagaaccgcggcttgtttgagttttataaggaattgattcgcttgcgccatcggctggcatcgctcaccaggggaaatgtccggtcttggcatgccgacaaacaagccaatctttatgcttttgtgcgcacggttcaagaccaacatgtcggtgtggttctcaataatcgtggcgagaagcaaaccgttttgctacaggtgccggaatcgggcggaaaaacttggctggattgtttgaccggagaagaagtgcatggcaaacaagggcaactgaagctgacacttcgcccttaccagggaatgattctctggaatggccggtag

SEQ ID NO: 800 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 801 - DNA, 24 bp, Artificial sequence
  primer
atgatgttaaatgcatggcacctg

SEQ ID NO: 802 - DNA, 24 bp, Artificial sequence
  primer
ttagttcatccataccgtagccga

SEQ ID NO: 803 - protein, 477 aa, Artificial sequence
  consensus sequence
  Variant (2)..(2): Xaa in position 2 is any amino acid
  Variant (4)..(9): Xaa in position 4 to 9 is any amino acid
  Variant (15)..(15): Xaa in position 15 is any amino acid
  Variant (18)..(33): Xaa in position 18 to 33 is any amino acid
  Variant (34)..(61): Xaa in position 34 to 61 is any or no amino acid
  Variant (66)..(66): Xaa in position 66 is any amino acid
  Variant (68)..(73): Xaa in position 68 to 73 is any amino acid
  Variant (76)..(77): Xaa in position 76 to 77 is any amino acid
  Variant (78)..(78): Xaa in position 78 is any or no amino acid
  Variant (81)..(84): Xaa in position 81 to 84 is any amino acid
  Variant (86)..(87): Xaa in position 86 to 87 is any amino acid
  Variant (89)..(89): Xaa in position 89 is any amino acid
  Variant (91)..(95): Xaa in position 91 to 95 is any amino acid
  Variant (97)..(97): Xaa in position 97 is any amino acid
  Variant (99)..(99): Xaa in position 99 is any amino acid
  Variant (101)..(101): Xaa in position 101 is any amino acid
  Variant (104)..(106): Xaa in position 104 to 106 is any amino acid
  Variant (109)..(110): Xaa in position 109 to 110 is any amino acid
  Variant (112)..(118): Xaa in position 112 to 118 is any amino acid
  Variant (120)..(123): Xaa in position 120 to 123 is any amino acid
  Variant (125)..(131): Xaa in position 125 to 131 is any amino acid
  Variant (132)..(135): Xaa in position 132 to 135 is any or no amino acid
  Variant (138)..(138): Xaa in position 138 is any amino acid
  Variant (143)..(149): Xaa in position 143 to 149 is any amino acid
  Variant (151)..(157): Xaa in position 151 to 157 is any amino acid
  Variant (158)..(169): Xaa in position 158 to 169 is any or no amino acid
  Variant (171)..(173): Xaa in position 171 to 173 is any amino acid
  Variant (174)..(174): Xaa in position 174 is any or no amino acid
  Variant (176)..(183): Xaa in position 176 to 183 is any amino acid
  Variant (184)..(198): Xaa in position 184 to 198 is any or no amino acid
  Variant (200)..(208): Xaa in position 200 to 208 is any amino acid
  Variant (209)..(209): Xaa in position 209 is any or no amino acid
  Variant (211)..(235): Xaa in position 211 to 235 is any amino acid
  Variant (236)..(243): Xaa in position 236 to 243 is any or no amino acid
  Variant (251)..(275): Xaa in position 251 to 275 is any amino acid
  Variant (276)..(287): Xaa in position 276 to 287 is any or no amino acid
  Variant (290)..(296): Xaa in position 290 to 296 is any amino acid
  Variant (297)..(305): Xaa in position 297 to 305 is any or no amino acid
  Variant (308)..(308): Xaa in position 308 is any amino acid
  Variant (310)..(312): Xaa in position 310 to 312 is any amino acid
  Variant (314)..(315): Xaa in position 314 to 315 is any amino acid
  Variant (319)..(353): Xaa in position 319 to 353 is any amino acid
  Variant (354)..(374): Xaa in position 354 to 374 is any or no amino acid
  Variant (376)..(376): Xaa in position 376 is any amino acid
  Variant (378)..(378): Xaa in position 378 is any amino acid
  Variant (383)..(383): Xaa in position 383 is any amino acid
  Variant (385)..(386): Xaa in position 385 to 386 is any amino acid
  Variant (388)..(405): Xaa in position 388 to 405 is any amino acid
  Variant (406)..(421): Xaa in position 406 to 421 is any or no amino acid
  Variant (423)..(423): Xaa in position 423 is any amino acid
  Variant (425)..(426): Xaa in position 425 to 426 is any amino acid
  Variant (430)..(430): Xaa in position 430 is any amino acid
  Variant (432)..(432): Xaa in position 432 is any amino acid
  Variant (434)..(435): Xaa in position 434 to 435 is any amino acid
  Variant (437)..(438): Xaa in position 437 to 438 is any amino acid
  Variant (439)..(445): Xaa in position 439 to 445 is any or no amino acid
  Variant (448)..(449): Xaa in position 448 to 449 is any amino acid
  Variant (451)..(454): Xaa in position 451 to 454 is any amino acid
  Variant (456)..(472): Xaa in position 456 to 472 is any amino acid
  Variant (473)..(476): Xaa in position 473 to 476 is any or no amino acid
PXWXXXXXXYQIFPXRFXXXXXXXXXXXXXXXXXXXXXXXXXXXXXXXXXXXXXXXXXXXXGGDLXGXXXXXXYLXXXLGXXXXYXXPXFXXXXXHXYXTXDYXXXDPXXGXXXXXXXLXXXXHXXXXXXXXXXXLDXVFNHXXXXXXXFXXXXXXXXXXXXXXXXXXXSXXXXWXXXXXXXXXXXXXXXXXXXXXXXYXXXXXXXXXXPXXXXXXXXXXXXXXXXXXXXXXXXXXXXXXXXXDGWRLDVXXXXXXXXXXXXXXXXXXXXXXXXXXXXXXXXXXXXXGEXXXXXXXXXXXXXXXXWLXGXXXDXXMNYXXXXXXXXXXXXXXXXXXXXXXXXXXXXXXXXXXXXXXXXXXXXXXXXXXXXXXXXNXLXSHDTXRXXTXXXXXXXXXXXXXXXXXXXXXXXXXXXXXXXXXXGXPXXYYGXEXGXXGXXXXXXXXXDPXXRXXXXWXXXXXXXXXXXXXXXXXXXXXR

SEQ ID NO: 804 - protein, 41 aa, Artificial sequence
  protein pattern
  Variant (3)..(3): Xaa in position 3 is Ala, Ile or Val
  Variant (4)..(4): Xaa in position 4 is Asp, Glu, Gly, Asn, Ser or Thr
  Variant (5)..(5): Xaa in position 5 is Ala, Gly, Ile, Leu or Val
  Variant (6)..(6): Xaa in position 6 is Ile, Leu, Met or Val
  Variant (8)..(8): Xaa in position 8 is Phe, Leu or Met
  Variant (9)..(9): Xaa in position 9 is Cys, Asn or Thr
  Variant (11)..(11): Xaa in position 11 is Ile, Leu or Val
  Variant (13)..(13): Xaa in position 13 is any amino acid
  Variant (14)..(14): Xaa in position 14 is Ala, Gly or Ser
  Variant (15)..(15): Xaa in position 15 is any amino acid
  Variant (16)..(16): Xaa in position 16 is Ala, Cys, Ser or Thr
  Variant (17)..(17): Xaa in position 17 is any amino acid
  Variant (19)..(19): Xaa in position 19 is Lys or Arg
  Variant (21)..(21): Xaa in position 21 is any amino acid
  Variant (23)..(23): Xaa in position 23 is any amino acid
  Variant (26)..(27): Xaa in position 26 to 27 is any amino acid
  Variant (28)..(28): Xaa in position 28 is Ile, Leu or Val
  Variant (30)..(32): Xaa in position 30 to 32 is any amino acid
  Variant (34)..(34): Xaa in position 34 is Asp, Gly, Asn, Ser or Thr
  Variant (35)..(40): Xaa in position 35 to 40 is any amino acid
  Variant (41)..(41): Xaa in position 41 is Leu, Met or Val
LGXXXXYXXPXFXXXXXHXYXTXDYXXXDXXXGXXXXXXXX

SEQ ID NO: 805 - protein, 20 aa, Artificial sequence
  protein pattern
  Variant (2)..(2): Xaa in position 2 is any amino acid
  Variant (3)..(3): Xaa in position 3 is Ile, Leu or Val
  Variant (4)..(4): Xaa in position 4 is Phe or Tyr
  Variant (7)..(7): Xaa in position 7 is Asp, Ser or Thr
  Variant (9)..(9): Xaa in position 9 is any amino acid
  Variant (11)..(11): Xaa in position 11 is Leu, Met or Val
  Variant (12)..(12): Xaa in position 12 is any amino acid
  Variant (14)..(15): Xaa in position 14 to 15 is any amino acid
  Variant (18)..(18): Xaa in position 18 is any amino acid
  Variant (19)..(19): Xaa in position 19 is Cys, Asn or Ser
PXXXYGXEXGXXGXXDPXXR

SEQ ID NO: 806 - protein, 22 aa, Artificial sequence
  protein pattern
  Variant (2)..(2): Xaa in position 2 is Asp or Glu
  Variant (3)..(5): Xaa in position 3 to 5 is any amino acid
  Variant (6)..(6): Xaa in position 6 is Asp, Glu, Asn, Gln, Ser or Thr
  Variant (7)..(10): Xaa in position 7 to 10 is any amino acid
  Variant (12)..(12): Xaa in position 12 is any amino acid
  Variant (13)..(13): Xaa in position 13 is Ala or Gly
  Variant (14)..(17): Xaa in position 14 to 17 is any amino acid
  Variant (18)..(18): Xaa in position 18 is Ala, Gly or Ser
  Variant (19)..(19): Xaa in position 19 is any amino acid
GXXXXXXXXXLXXXXXXXXMNY

SEQ ID NO: 807 - protein, 20 aa, Artificial sequence
  protein pattern
  Variant (2)..(2): Xaa in position 2 is Ala, Asp, Glu, Asn, Gln, Ser or Thr
  Variant (4)..(7): Xaa in position 4 to 7 is any amino acid
  Variant (8)..(8): Xaa in position 8 is Ile or Val
  Variant (9)..(9): Xaa in position 9 is any amino acid
  Variant (15)..(15): Xaa in position 15 is Asp or Glu
  Variant (18)..(19): Xaa in position 18 to 19 is any amino acid
  Variant (20)..(20): Xaa in position 20 is Ala, Gly, Ser or Thr
PXWXXXXXXYQIFPXRFXXX

SEQ ID NO: 808 - protein, 15 aa, Artificial sequence
  protein pattern
  Variant (3)..(3): Xaa in position 3 is Ala or Gly
  Variant (8)..(8): Xaa in position 8 is any amino acid
  Variant (9)..(9): Xaa in position 9 is Gly or Ser
  Variant (10)..(14): Xaa in position 10 to 14 is any amino acid
  Variant (15)..(15): Xaa in position 15 is Phe or Trp
LDXVFNHXXXXXXXX

SEQ ID NO: 809 - protein, 10 aa, Artificial sequence
  protein pattern
  Variant (2)..(2): Xaa in position 2 is any amino acid
  Variant (3)..(3): Xaa in position 3 is Ile, Leu or Val
  Variant (4)..(4): Xaa in position 4 is Ala, Asp, Glu, Gly or Asn
  Variant (9)..(9): Xaa in position 9 is any amino acid
NXXXSHDTXR

SEQ ID NO: 810 - protein, 13 aa, Artificial sequence
  protein pattern
  Variant (2)..(3): Xaa in position 2 to 3 is any or no amino acid
  Variant (7)..(7): Xaa in position 7 is Phe or Leu
  Variant (9)..(9): Xaa in position 9 is Ala, Cys or Val
  Variant (10)..(10): Xaa in position 10 is Ala, Gly, Ile, Pro or Val
  Variant (11)..(12): Xaa in position 11 to 12 is any amino acid
  Variant (13)..(13): Xaa in position 13 is Ile, Leu or Val
DXXGWRXDXXXXX

SEQ ID NO: 811 - protein, 13 aa, Artificial sequence
  protein pattern
  Variant (2)..(2): Xaa in position 2 is any or no amino acid
  Variant (5)..(5): Xaa in position 5 is Cys, Asp or Asn
  Variant (6)..(6): Xaa in position 6 is Phe, Ile or Leu
  Variant (7)..(7): Xaa in position 7 is any amino acid
  Variant (9)..(9): Xaa in position 9 is Ile or Val
  Variant (10)..(12): Xaa in position 10 to 12 is any amino acid
  Variant (13)..(13): Xaa in position 13 is Ile, Leu, Met or Val
FXGGXXXGXXXXX

SEQ ID NO: 812 - DNA, 645 bp, Escherichia coli
  CDS (1)..(645): transl_table=11
atgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgtaatggtttcctgttggacggcttcccgcgtaccattccgcaggcagacgcgatgaaagaagcgggcatcaatgttgattacgttctggaattcgacgtaccggacgaactgatcgttgaccgtatcgtcggtcgccgcgttcatgcgccgtctggtcgtgtttatcacgttaaattcaatccgccgaaagtagaaggcaaagacgacgttaccggtgaagaactgactacccgtaaagatgatcaggaagagaccgtacgtaaacgtctggttgaataccatcagatgacagcaccgctgatcggctactactccaaagaagcagaagcgggtaataccaaatacgcgaaagttgacggcaccaagccggttgctgaagttcgcgctgatctggaaaaaatcctcggctaa

SEQ ID NO: 813 - protein, 214 aa, Escherichia coli
MRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRADLEKILG

SEQ ID NO: 814 - DNA, 1311 bp, Glycine max
  CDS (166)..(894)
attgaacaaaggagacgacaaacgtgtgtagctaaacaaagggcaagagacggcgagttgagttttgaaagcgtgtgcgtgggagggtccgaagttggagatagtgattctggttctgttctgttcttctttctactcacaacaacatcagaatcagaaacaacaatggccaacactaacttggaagatgttccctctctggatctcatgactgagctccttcgtcgtctcaagtgctcttccaaacctgacaagcgtcttattctcattggcccacctggatctgggaaaggcacccagtcaccaatcataaaagatgagtactgcttatgccacttagctactggtgatatgttaagagcagctgtagcagctaagacccctcttggtgtcaaggctaaagaagctatggataagggagaacttgtttctgatgacttggttgttggcattatagatgaagcaatgaaaaaaccttcatgtcagaaaggtttcattcttgatggttttccaagaactgtggtccaagcacagaagcttgatgagatgctgcaaaaccaaggagttaaagttgataaggtgctcaattttgcaattgatgatgcaatccttgaggagcgaattactggtcgctggatacacccatccagtggcagaacctaccatacaaaatttgctcctcctaaggttcttggtgttgatgatgttactggtgaaccacttatccagcgcaaggatgacactgcagctgttcttaagttaagactggaggcatttcacaagcaaaccgaaccggttattgattactattcaaagaagggccttgttgctaatcttcatgctgagaaaccacccaaagaggtgacagttgaagtggagaaagtgctgtcttaaaacatagttcatcttttgatctcgggcttgaactgcaattgttcttttttcgctataggaaaacttttcgttgccaatttgtattttaatatactctgaaatccgcttacctttcagctttactgcaaatgccggctgttctcaaacccacattcgaagaccaactttgatgaatcaaaaagtctatttattttgaattttggtctctttcttttttctgcatgaatttccactcgacattcgcaggtgtttacgcacccgtgaaacttttgatttcatgaactagttggcaaaatttgagctacttattgttgggaagcatttgtgctgcttttgaaggtgtgaaatgaaaaattgtaagaaataattgtttggtctgtgtttcattattttatttctatatattgtgatattaaa

SEQ ID NO: 815 - protein, 242 aa, Glycine max
MANTNLEDVPSLDLMTELLRRLKCSSKPDKRLILIGPPGSGKGTQSPIIKDEYCLCHLATGDMLRAAVAAKTPLGVKAKEAMDKGELVSDDLVVGIIDEAMKKPSCQKGFILDGFPRTVVQAQKLDEMLQNQGVKVDKVLNFAIDDAILEERITGRWIHPSSGRTYHTKFAPPKVLGVDDVTGEPLIQRKDDTAAVLKLRLEAFHKQTEPVIDYYSKKGLVANLHAEKPPKEVTVEVEKVLS

SEQ ID NO: 816 - DNA, 1410 bp, Glycine max
  CDS (91)..(945)
gcgctgttacggctgcgagaagacgacagaagggaaaataagaatgaatgaaaggcattagaaatcagtgaccggcgtgagagagcaaagatggtggttcttggcaccacctcaccttcaatttcctgcttgccgtcttcaactcaaaccgactacaaggcgcgtcgatactgttcttttccgcaacgcccacgcccacgcccacgcgcttcacgtttcttttgcggatcccctttcgctccaaatgccatccattctccttctctgtctgtgacgaatgaagcactgaatgttatgatttctggggctcctgcttctggtaaaggaacccagtgccacctcatcaccaacaagtacggtttggttcatattgctgctggagatttacttagggcagaaattgccactggaagtgataatggaaagcgagccaaacagtatatggagaagggacagttggtccctgacgaaattgttgtgatgatggttaaggagcgtctcttgaaaccagattcgaaagagaatggttggcttttggatggatatcccaggagcttatcacaggccactgcacttgaggctcttggctttcggcctcatatttttcttcttcttgaggtttctgaagatgttcttgtggagagagtagttggacggagattagatcctgttaccggcaagatatatcacttgaagtattctcctccagagacacaagaaatagccgcaaggcttacccaacgctttgatgatacagaagaaaaggtgaaattgcgattgaatacccatcatcaaaatgtggagtcagtcctttccatgtacaaagacataactgttaagattaacggaaatgtctcaaaggaggaagtatttgctcaaattgatagtgcactgacaagtcttatagaggaaaggaaggctgcttcaggatctgtggcagcatagaagacccatcttttgacattttgatctagcatggtgcgttgctggtggtagtggattttaaatgatttatttatagagttaaacaaaagagtcttcactcaaactaagctgcattttctcgtgaagattgtctcacggcttatatcctcccatttggaaagcaatgtgatgattggcttggaccatgcatgaggacctgtgatagtgtagtgcgcagtatattttacaaatttattttttatgagaaaatgattaccttaaattaaaatcgtttttatgtaatgactagcttgtaaatgcaggattttgtgaattatcgtttgttggtttcctgttactgcttggtccgtatgtggtgttctttaccattttttgtccgaaaatcagacattagatctaccataaaagagaataatttattttatgttgttggcttaaaaaaaaaaaaaaaaaaaaaacccaaaa

SEQ ID NO: 817 - protein, 284 aa, Glycine max
MVVLGTTSPSISCLPSSTQTDYKARRYCSFPQRPRPRPRASRFFCGSPFAPNAIHSPSLSVTNEALNVMISGAPASGKGTQCHLITNKYGLVHIAAGDLLRAEIATGSDNGKRAKQYMEKGQLVPDEIVVMMVKERLLKPDSKENGWLLDGYPRSLSQATALEALGFRPHIFLLLEVSEDVLVERVVGRRLDPVTGKIYHLKYSPPETQEIAARLTQRFDDTEEKVKLRLNTHHQNVESVLSMYKDITVKINGNVSKEEVFAQIDSALTSLIEERKAASGSVAA

SEQ ID NO: 818 - DNA, 639 bp, Zea mays
  CDS (1)..(639)
atgggcacagttgtggatgctccagcagttgtggctgaagaggtcactgaaaacatgttgggtggtaagaaagttacagttgtatttgttctaggtggtcctggaagtggaaaaggcacacagtgtgccaacattgtggaacactttggattcacccatcttagtgctggagatcttttgcgtgcagagattaaatctggctctgagaatggaaccatgattgaaaacatgataaaggagggaaagattgttccatcagaggtgactataaagctgttgcaggaggcaatgataaaaaatgaaaatgacaaattcctgatcgacggatttccaaggaatgaggagaatcgtgcagcatttgagaatgttaccaaaatttctcctgcatttgtgctattctttgactgttctgagaaagagatggagaaacgtctcttgggacgcaatcagggaagagttgatgataacattgaaactatcaaaaaaaggttcaaaacctttgttgagtcaagtttgcctgtcattgagcattacaactcaagggacaaggttaaaaagattgatgctgcaaaaccaattcctgaggtgtttgaagacgtcaaaaccatttttgccccatatgctccaaaggctgaatag

SEQ ID NO: 819 - protein, 212 aa, Zea mays
MGTVVDAPAVVAEEVTENMLGGKKVTVVFVLGGPGSGKGTQCANIVEHFGFTHLSAGDLLRAEIKSGSENGTMIENMIKEGKIVPSEVTIKLLQEAMIKNENDKFLIDGFPRNEENRAAFENVTKISPAFVLFFDCSEKEMEKRLLGRNQGRVDDNIETIKKRFKTFVESSLPVIEHYNSRDKVKKIDAAKPIPEVFEDVKTIFAPYAPKAE

SEQ ID NO: 820 - DNA, 639 bp, Zea mays
  CDS (1)..(639)
atgggcacagttgtggatgctccagcagttgtggctgaagaggtcactgagaacatgttgggtggtaagaaagttacagctgtatttgttctaggtggtcctggaagtggaaaaggcacacagtgtgccaacattgtggaacactttggattcacccatcttagtgctggagatcttttgcgtgcagagattaaatctggctctgagaatggaaccatgattgaaaacatgataaaggagggaaagattgttccatcagaggtgactataaagctgttgcaggaggcaatgataaaaaatgaaaatgacaaattcctgatcgacggatttccaaggaatgaggagaatcgtgcagcatttgagaatgttaccaaaatttctcctgcatttgtgctattctttgactgttctgagaaagagatggagaaacgtctcttggggcgcaatcagggaagagttgatgataacattgaaactatcaaaaaaaggttcaaaacctttgttgagtcaagtttgcctgtcattgagcattacaactcaagggacaaggttaaaaagattgatgctgcaaaaccaattcctgaggtgtttgaagacgtcaaaaccatttttgccccatatgctccaaaggctgaatag

SEQ ID NO: 821 - protein, 212 aa, Zea mays
MGTVVDAPAVVAEEVTENMLGGKKVTAVFVLGGPGSGKGTQCANIVEHFGFTHLSAGDLLRAEIKSGSENGTMIENMIKEGKIVPSEVTIKLLQEAMIKNENDKFLIDGFPRNEENRAAFENVTKISPAFVLFFDCSEKEMEKRLLGRNQGRVDDNIETIKKRFKTFVESSLPVIEHYNSRDKVKKIDAAKPIPEVFEDVKTIFAPYAPKAE

SEQ ID NO: 822 - DNA, 1355 bp, Zea mays
  CDS (209)..(934)
ccattttgtcgtattcggctcagctgcagtccagagttggaacccaagcgcacgcagcaccgtcggccgggaacccgacgaaaaggcccaacaaccccccgacccgtcacctgacccagccgatcgagaatacccggaaggccggaacccacctgctgcgcacctgcaagcctcgagtggagctcttcccgttgcattggcggcggagatggcggcgaatctggaggacgtgccgtcgctggatctgatgcacgagttgctccgccgcatgaagtgcagctccaagcccgacaagcgcctcatcgtcatcggcccacctggctctggaaagggaacccagtctcccattattaaggatgaatattgcttgtgccatttagccactggtgatatgctgagggctgctgtggcggccaagacacctctaggtatcaaggcaaaagaagctatggataagggagagcttgtttcagatgacatggttgtggggattattgatgaagctatgaagaaaccttcatgccagaaaggtttcattcttgatggctttcctagaactgtcactcaagcacagaagctcgatgaaatgttggcaaagcaaggtgctaatgttgacaaggtcctgaacttcgcaattgatgatgctatattggaagaacggattactggtcgttggatccattcggccagtggtaggacttaccattcaaaatttgcacctccaaagtctccgggagttgatgatgtaactggagagccattgattcaacgaagagatgacacagccgaggttttgaagtcaaggcttgaagccttccacaaacaaactgagcctgtgattgattattactctaagaagggcttggtggtaaatctgcctgcggagaaaccaccaaaggaagtgactgctgaggtgctgaaagccctctcatgatgaagtgtccactcttgaggttaaacatgacatctaccaaaacccctttgtttgggtttcttcaaaatttgcactaggccaacatcatgaggttttttattttcagtatccttattgtgcggatgcaccattttttgttatcacacctttgacaagctcggcaactgtctgaataatttctgtttctaatgatggaactgtttttccagtaacaaactgatatgattacaacaattcatctttgggagaatttccctgcaaaaaaaaaaaaaaaaagcggccagcctagttccagttattacaagactgctatgttactggctatgataatcaggaagataccttgctctgtcgagccttgagcggagagattgatgtgctgcgagctcaaataaatgttcatgttggtatggttcccaaa

SEQ ID NO: 823 - protein, 241 aa, Zea mays
MAANLEDVPSLDLMHELLRRMKCSSKPDKRLIVIGPPGSGKGTQSPIIKDEYCLCHLATGDMLRAAVAAKTPLGIKAKEAMDKGELVSDDMVVGIIDEAMKKPSCQKGFILDGFPRTVTQAQKLDEMLAKQGANVDKVLNFAIDDAILEERITGRWIHSASGRTYHSKFAPPKSPGVDDVTGEPLIQRRDDTAEVLKSRLEAFHKQTEPVIDYYSKKGLVVNLPAEKPPKEVTAEVLKALS

SEQ ID NO: 824 - DNA, 1245 bp, Zea mays
  CDS (125)..(991)
cccacgcgtcggccccaagtcgaactcaaacccggcaagaactcagtcacgaacgcacgacaaaaggaagaaaaacccaagaaatatctctgcggccctgctcgtcccgagccgagccggcgagatggcggggatgtctcgcgcgatccgcaacttcgccgccgcgtcccggcgaaccctgaccgctgcttcggggccggcgctgccgaaggaggcggcggcggcgggggcgcgggtgagggcggcggcgcccgggcgcatggggcgggatcaggaggacgggaggcgcgtgcagtgggtgttcctcgggtgccccggggtggggaagggcacctacgccagccgcctctcgcagctgctcggcgtcccgcacatcgccaccggcgacctcgtccgcgacgccctggccacccctggccccttctccaacaagcttgctgagattgtcaatcatggaaaactggtgtctgatgagatcatcataaatctgctgtcaagacgtctggaagagggagaggaaaagggtgaattggggttcatccttgatggctttcctcgaaccataggacaagcggagatacttgaaggagtcacagacattgatttggtgatcaatctcaaactccgagaagaagctctgcttgcgaaatgccttggcaggaggatgtgcagccagtgtggagggaacttcaatgtggcctccattgatattgagggtgaagacggcgggcctcgaatgtacatgcccccactgttgcctcctccacagtgtgaatcgaagctgattgctagagcagacgatactgaagaagtggtaaaagagcggctgcgtgtgtaccatgatttgactgaaccagtggaggagttctacagagcacgtgggaaactgctggagttcaatctgcctggtgggatacccgaatcatggccgaagttattgcaggccctgaacatagaagaccccgacaataagcgatctgcagcagcatgattcttgttttgttataggaatgcacattctaaattgaacatctgtagactatgtcaaagctagtcaaattggtgggcattccttacatctttgggaagcctactccattctggatccagattattgtggcatggcactcaactgtacagtagattgatcatcgattggcaaggtcgatcgatggatgtgctgactgtgatcctcgaacgtaaggtgtgtaaaaaggcaagaaaataattgttgggcgtcgagac

SEQ ID NO: 825 - protein, 288 aa, Zea mays
MAGMSRAIRNFAAASRRTLTAASGPALPKEAAAAGARVRAAAPGRMGRDQEDGRRVQWVFLGCPGVGKGTYASRLSQLLGVPHIATGDLVRDALATPGPFSNKLAEIVNHGKLVSDEIIINLLSRRLEEGEEKGELGFILDGFPRTIGQAEILEGVTDIDLVINLKLREEALLAKCLGRRMCSQCGGNFNVASIDIEGEDGGPRMYMPPLLPPPQCESKLIARADDTEEVVKERLRVYHDLTEPVEEFYRARGKLLEFNLPGGIPESWPKLLQALNIEDPDNKRSAAA

SEQ ID NO: 826 - DNA, 1165 bp, Zea mays
  CDS (79)..(825)
gccggccgtttcgaaatccaaactgtctcttcacgtccttccgggtcctatcgctcctctccgtcgccggtggagctcatggcatcctccatggccgccgccgcctccgcctccgcctccgcctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcggagatcgctgctggctctgagaatgggaagcgggccaaggaattcatggagaagggccagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacgcaaagatttgacgatacagaagaaaaggttaagttgaggctggagacttattaccaaaatatcgagtccttgctatcaacatatgagaacattattgtcaaagtgcaaggagatgccacagtcgatgctgtctttgctaagatcgacgagctgctgggttctatcctggagaagaaaaatgaaatggtgtccagcacatgagcaaggtaaaaatgattgggtgcagtgcagatccgacaagttcatgtaatgcaagtcacctctcatgataggaacttctccaggggaatatatctgaaacacaggacgacacgtacaagtaatgtaagccagtctcacatgatggaaacttctccatgtggatgtggtcaaagcataggaatttttttcctccaattgttaactgtacgcgaatggaagcaacagatcattcgtaggttgtgagggcttcagagatcatctgctgctgtacatgttttgttgctgtcttgtgaacatacatgtcttgttgtttcgcaaaaaaaaaaaaaaaaaagcggcc

SEQ ID NO: 827 - protein, 248 aa, Zea mays
MASSMAAAASASASASSPRATKAVVAALADPLKVMISGAPASGKGTQCELIKTKYQLAHISAGDLLRAEIAAGSENGKRAKEFMEKGQLVPDEIVVNMVKERLRQPDAQENGWLLDGYPRSYSQAMALETLEIRPDTFILLDVPDELLVERVVGRRLDPVTGKIYHLKYSPPENEEIASRLTQRFDDTEEKVKLRLETYYQNIESLLSTYENIIVKVQGDATVDAVFAKIDELLGSILEKKNEMVSST

SEQ ID NO: 828 - DNA, 1279 bp, Zea mays
  CDS (91)..(945)
cattgggtacctcgaggccggccggggtccaaactgtctcttccacgtccttccgggtcctatcgctcctctccgtcgccggtggagctcatggcatcctccatggccgccgccgccaccgccaccgccctcccgctgccgtccgggacgacgcagaggccgtctgcccagggccgcctcctcttcaccgccgcgcccgcccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcggagatcgctgctggctctgagaatgggaagcgggccaaggaattcatggagaagggccagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgttaaagtgcaaggagatgccacagtggatgctgtctttgctaagatcgacgagctgctgggttctatcctggagaagaaaaatgaaatggtgtccagcacatgagcaaggaacttctccaggggaatatatctgaagcacaggacgacacgtacaagtaatgtaagccagtctcacgtaatggaaatttctccatgtggatgtggtcaaagcataggattttttttctccaattgttaactgtacgcgaatggaagcgacagatcattcgtaggttgtgagggcttcaaagatcatctgctgctgtacatgttttgttgctgtcttgtgaacatacatgtcttgttgtttctcaactggaggaatgctgttaacctgctgtatcatttccttgaatggcttatgtgagagggaggaggacctgagcagcagctcttgc

SEQ ID NO: 829 - protein, 284 aa, Zea mays
MASSMAAAATATALPLPSGTTQRPSAQGRLLFTAAPARSLRLRPAGRRSARSSPRATKAVVAALADPLKVMISGAPASGKGTQCELIKTKYQLAHISAGDLLRAEIAAGSENGKRAKEFMEKGQLVPDEIVVNMVKERLRQPDAQENGWLLDGYPRSYSQAMALETLEIRPDTFILLDVPDELLVERVVGRRLDPVTGKIYHLKYSPPENEEIASRLTQRFDDTEEKVKLRLETYYQNIESLLSTYENIIVKVQGDATVDAVFAKIDELLGSILEKKNEMVSST

SEQ ID NO: 830 - DNA, 1489 bp, Zea mays
  CDS (125)..(985)
ggctggttccttcgacagcggggatatttcatccattgggtacctcgaggccggccggggtccaaaactgtctcttccacgtccttccgggtcctatcgctcctctccgtcgccggtggagctcatggcatcctccatggccgccgccgccaccgccctcccgctgccgtccgggacgacgcagaggccgtctgcccagggccgcctcctcttcaccgccgcacccgcccgctcccgctgccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgctggagatttgttgcgggcggagatcgctgctggctctgagaatgggaagcgggccaaggaattcatggagaagggccagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgtcaaagtgcaaggagatgccacagtggatgctgtctttgctaagatcgacgagctgctgggttctatcctggagaagaaaaatgaaatggtgtccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttctccatgtggatgtggtcaaagcataggattttttttcctccaattattaactgtacgcgaatggaagcgacagatcattcgtaggttgtgagggcttcaaagatcatctgctgctgtacatgttttgttgctgtcttgtgaacatacatgtcttgttgtttctcaactggaggaatgctgttaacctgctgtatcatttccttgaatggcttatgtgagagggaggaggacctgagcagcagctcttgcaatctttgtctaaattccttcggatggtgaaggccatttcgcctgttctccgaaaagtatattggctgcattttccgaaaaaaaaaaaaaaaaaaggccccta

SEQ ID NO: 831 - protein, 286 aa, Zea mays
MASSMAAAATALPLPSGTTQRPSAQGRLLFTAAPARSRCRSLRLRPAGRRSARSSPRATKAVVAALADPLKVMISGAPASGKGTQCELIKTKYQLAHISAGDLLRAEIAAGSENGKRAKEFMEKGQLVPDEIVVNMVKERLRQPDAQENGWLLDGYPRSYSQAMALETLEIRPDTFILLDVPDELLVERVVGRRLDPVTGKIYHLKYSPPENEEIASRLTQRFDDTEEKVKLRLETYYQNIESLLSTYENIIVKVQGDATVDAVFAKIDELLGSILEKKNEMVSST

SEQ ID NO: 832 - DNA, 1276 bp, Zea mays subsp. mays
  CDS (145)..(1002)
tctctctctctctctctcgtgcgtgtcgaagactcgaagtcgaactcaaaacacgcaacacgcaagtcacgaacgcacgacaaaaggaagaaaaacccaagaaatatctctgcggccctgctcgtcccgagccgagccggcgagatggcggggatgtctcgcgcgatccgcaacttcgccgccgcgtcccggcgaaccctgaccgctgcttcggggccggcgctgccgaaggaggcggcggcgcgggtgagggcgggggcgcccgggcgcatggggcgggatcaggaggacgggaggcgcgtgcagtgggtgttcctcgggtgccccggggtggggaagggcacctacgccagccgcctctcgcagctgctcggcgtcccgcacatcgccaccggcgacctcgtccgcgacgccctggccacccctggccccttctccaacaagcttgctgagattgtcaatcatggaaaactggtgtctgatgagatcatcataaatctgctgtcaagacgtctggaagagggagaggaaaagggtgaattggggttcatccttgatggctttcctcgaaccataggacaagcggagatacttgaaggagtcacagacattgatttggtgatcaatctcaaactccgagaagaagctctgcttgcgaaatgccttggcaggaggatgtgcagccagtgtggagggaacttcaatgtggcctccattgatattgagggtgaagacggcgggcctcgaatgtacatgcccccactgttgcctcctccacagtgtgaatcgaagctgattgctagagcagacgatactgaagaagtggtaaaagagcggctgcgtgtgtaccatgatttgactgaaccagtggaggagttctacagagcacgtgggaaactgctggagttcaatctgcctggtgggatacccgaatcatggccgaagttactgcaggccctgaacatagaagaccccgacaataagcgatctgcagcagcatgattcttgttttgttataggaatgcacattctaaattgaacatctgtagactatgtcaaagctagtcaaattggtgggcattccttacatctttgggaagcctactccattctggatccagattattgtggcatggcactcaactgtacagtagattgatcatcgattggcaaggtcgatcgatggatgtgctgactgtgatcctcgaacgtaaggtgtgtaaaaaggcaagaaaataattgttgggcgtcgagacattcacttgtaggtcgtacc

SEQ ID NO: 833 - protein, 285 aa, Zea mays subsp. mays
MAGMSRAIRNFAAASRRTLTAASGPALPKEAAARVRAGAPGRMGRDQEDGRRVQWVFLGCPGVGKGTYASRLSQLLGVPHIATGDLVRDALATPGPFSNKLAEIVNHGKLVSDEIIINLLSRRLEEGEEKGELGFILDGFPRTIGQAEILEGVTDIDLVINLKLREEALLAKCLGRRMCSQCGGNFNVASIDIEGEDGGPRMYMPPLLPPPQCESKLIARADDTEEVVKERLRVYHDLTEPVEEFYRARGKLLEFNLPGGIPESWPKLLQALNIEDPDNKRSAAA

SEQ ID NO: 834 - DNA, 1276 bp, Zea mays subsp. mays; identical to SEQ ID NO: 832
  CDS (154)..(1002)

SEQ ID NO: 835 - protein, 282 aa, Zea mays subsp. mays
MSRAIRNFAAASRRTLTAASGPALPKEAAARVRAGAPGRMGRDQEDGRRVQWVFLGCPGVGKGTYASRLSQLLGVPHIATGDLVRDALATPGPFSNKLAEIVNHGKLVSDEIIINLLSRRLEEGEEKGELGFILDGFPRTIGQAEILEGVTDIDLVINLKLREEALLAKCLGRRMCSQCGGNFNVASIDIEGEDGGPRMYMPPLLPPPQCESKLIARADDTEEVVKERLRVYHDLTEPVEEFYRARGKLLEFNLPGGIPESWPKLLQALNIEDPDNKRSAAA

SEQ ID NO: 836 - DNA, 970 bp, Glycine max
  CDS (33)..(788)
agaacatcctaatcgaaaaaattctcaaagcaatgcaacaaaaaatgttgaactccacacccacctgcttccaccgcaccaccactctcactccctctccttctcttctatccactcctcttccttcttgttcttcttcttccacccatcatcattcatatctacacccccgccactcctccttccacactcaacctcttcgcttaagcaacctccgctaccacacccatttgccatcaacccccaagacactcaaagtgaactgttccaccagcgagcctctgaaggtcatgatatcaggtgcacctgcatcgggcaaaggcacgcaatgtgaattgattgtccaaaagtttggattggtgcatatatcaacaggggatttgctaagagcagaggtagcggctgggactgaaattggaaataaagcaaaggagttcatgaacacgggtcaattggttcctgatgaaattgtgacagcgatggtggcagcacgattggctcgcgaagatgttaggcataaagggtggcttcttgatgggtaccctcggagttttggccaagcccagagtctggagaaaatgcagatacggcctgatgtgtatatcgtattagatgttcctgatgaaattctgatcgacagatgtgttggtagaaggctagacccagtgacagggaagatatatcatctaaagttttttccaccggatacagaagaaattaaagcaaggctgataactcggcctgatgacactgaggagaagttatttgaaaggatggactcatcatgaaatgatctcctaaagtcttgtctccgtggatgcgcagtagattttgttgcatgacaagtttgatcacaaaattaatgagaatttaaagatcttagttgtcaaagttttagactgtattttcagcagaatcattaaagacgctttatcagttagcataatgcattattaggatggtgtcattt

SEQ ID NO: 837 - protein, 251 aa, Glycine max
MQQKMLNSTPTCFHRTTTLTPSPSLLSTPLPSCSSSSTHHHSYLHPRHSSFHTQPLRLSNLRYHTHLPSTPKTLKVNCSTSEPLKVMISGAPASGKGTQCELIVQKFGLVHISTGDLLRAEVAAGTEIGNKAKEFMNTGQLVPDEIVTAMVAARLAREDVRHKGWLLDGYPRSFGQAQSLEKMQIRPDVYIVLDVPDEILIDRCVGRRLDPVTGKIYHLKFFPPDTEEIKARLITRPDDTEEKLFERMDSS

SEQ ID NO: 838 - DNA, 970 bp, Glycine max; identical to SEQ ID NO: 836
  CDS (45)..(788)

SEQ ID NO: 839 - protein, 247 aa, Glycine max
MLNSTPTCFHRTTTLTPSPSLLSTPLPSCSSSSTHHHSYLHPRHSSFHTQPLRLSNLRYHTHLPSTPKTLKVNCSTSEPLKVMISGAPASGKGTQCELIVQKFGLVHISTGDLLRAEVAAGTEIGNKAKEFMNTGQLVPDEIVTAMVAARLAREDVRHKGWLLDGYPRSFGQAQSLEKMQIRPDVYIVLDVPDEILIDRCVGRRLDPVTGKIYHLKFFPPDTEEIKARLITRPDDTEEKLFERMDSS

SEQ ID NO: 840 - DNA, 1242 bp, Glycine max
  CDS (52)..(906)
aagaatgaatgaaaggcattagaaatcagtgaccggcgtgagagagcaaagatggtggttcttggcaccacctcaccttcaatttcctgcttgccgtcttcaactcaaaccgactacaaggcgcgtcgatactgttcttttccgcaacgcccacgcccacgcccacgcgcttcacgtttcttttgcggattccctttcgctccaaatgccatccattctccttctctgtctgtgacgaatgaagcactgaatgttatgatttctggggctcctgcttctggtaaaggaacccagtgccacctcatcaccaacaagtacggtttggttcatattgctgctggagatttacttagggcagaaattgccactggaagtgataatggaaagcgagccaaacagtatatggagaagggacagttggtccctgacgaaattgttgtgatgatggttaaggagcgtctcttgaaaccagattcgaaagagaatggttggcttttggatggatatcccatgagcttatcacaggccactgcacttgaggctcttggctttcggcctcatatttttcttcttcttgaggtttctgaagatgttcttgtggagagagtagttggacggagattagatcctgttaccggcaagatatatcacttgaagtattctcctccagagacacaagaaatagccgcaaggcttacccaacgctttgatgatacagaagaaaaggtgaaattgcgattgaatacccatcatcaaaatgtggagtcagtcctttccatgtacaaagacataactgttaagattaacggaaatgtctcaaaggaggaagtatttgctcaaattgatagtgcactgacaagtcttatagaggaaaggaaggctgcttcaggatctgtggcagcatagaagacccatcttttgacattttgatctagcatggtgcgttgctggtggtagtggattttaaatgatttatttatagagttaaacaaaagagtcttcactcaaactaagctgcattttctcgtgaagattgtctcacggcttatatcctcccatttggaaagcaatgtgatgattggcttggaccatgcatgaggacctgtgatagtgtagtgcgcagtatattttacaaatttattttttatgagaaaatgattaccttaaattaaaatcgtttttatgtaatgactagcttgtaaatgcaggattttgtgaattatcgtttgttggtttcctgtt

SEQ ID NO: 841 - protein, 284 aa, Glycine max
MVVLGTTSPSISCLPSSTQTDYKARRYCSFPQRPRPRPRASRFFCGFPFAPNAIHSPSLSVTNEALNVMISGAPASGKGTQCHLITNKYGLVHIAAGDLLRAEIATGSDNGKRAKQYMEKGQLVPDEIVVMMVKERLLKPDSKENGWLLDGYPMSLSQATALEALGFRPHIFLLLEVSEDVLVERVVGRRLDPVTGKIYHLKYSPPETQEIAARLTQRFDDTEEKVKLRLNTHHQNVESVLSMYKDITVKINGNVSKEEVFAQIDSALTSLIEERKAASGSVAA

SEQ ID NO: 842 - DNA, 1242 bp, Glycine max; identical to SEQ ID NO: 840
  CDS (256)..(906)

SEQ ID NO: 843 - protein, 216 aa, Glycine max
MISGAPASGKGTQCHLITNKYGLVHIAAGDLLRAEIATGSDNGKRAKQYMEKGQLVPDEIVVMMVKERLLKPDSKENGWLLDGYPMSLSQATALEALGFRPHIFLLLEVSEDVLVERVVGRRLDPVTGKIYHLKYSPPETQEIAARLTQRFDDTEEKVKLRLNTHHQNVESVLSMYKDITVKINGNVSKEEVFAQIDSALTSLIEERKAASGSVAA

SEQ ID NO: 844 - DNA, 1147 bp, Triticum aestivum
  CDS (151)..(792)
tcgcaccaacgccacagacagaccaacaccgcagcacgcaccacgcgccccccccccccaccctgtgatccctcgccgtggtctcgccgccgcgccgacccctccaccggcattcgattcggagcgcagctcgtccgccggcgcggagccatgggcacggttgtggatgctcccgcagttgtgactgagaaggaggtggttgctgagaacatgttgggtgacaagaaagtcacagtagtatttgttcttggcggtcctggaagtggaaagggcacacagtgttccaacattgttgaacactttggattcacccatcttagtgctggagatcttttgcgcgcggagattaaatctggctctgagaatggaactatgattgagaacatgataaaggagggaaagattgttccgtcggaggtgactataaagctcttgcagcaagccatgataaagaatgagaatgataagttcctcatcgacgggtttccaaggaatgaagagaatcgtgctgcgttcgagaatgttacaaaaatttcgcctgcatttgtgctattcttcaattgttccgaggaagagatggaaaggcgtcttttgggacgcaatgagggtagagttgatgacaacatcgagactatcaggaagagattcaaagtttttgttgaatccagtttgcctgtgattgagtactatgacgcgaaggacaaggttaagaagatcgatgctgcaaaaccaattcctgaggtgtttgaagatgtcaaagccatttttgccccatatgccaaggctacatagaacagtataaaggaccacaaaggtgataaatggaatgatttcatacaaggttttgctcaagtgtgactacatatctgtgattacaaacccttaatatagatcagacttatcagtagacaatttgatttgttgccagcaataagttagatctggtttgtggtgttcctgctagaagtttttatttaccacccattgttggtgtatcccatgtagtatacctgtaccattgtgtaatttacggtaaggacggatcagaccttgtgcccatgagctatccggttgtattacagaaaattgaacttatcacatgttcactcatatttacattctttatacactgttggttcttctgttg

SEQ ID NO: 845 - protein, 213 aa, Triticum aestivum
MGTVVDAPAVVTEKEVVAENMLGDKKVTVVFVLGGPGSGKGTQCSNIVEHFGFTHLSAGDLLRAEIKSGSENGTMIENMIKEGKIVPSEVTIKLLQQAMIKNENDKFLIDGFPRNEENRAAFENVTKISPAFVLFFNCSEEEMERRLLGRNEGRVDDNIETIRKRFKVFVESSLPVIEYYDAKDKVKKIDAAKPIPEVFEDVKAIFAPYAKAT

SEQ ID NO: 846 - DNA, 1147 bp, Triticum aestivum; identical to SEQ ID NO: 844
  CDS (211)..(792)

SEQ ID NO: 847 - protein, 193 aa, Triticum aestivum
MLGDKKVTVVFVLGGPGSGKGTQCSNIVEHFGFTHLSAGDLLRAEIKSGSENGTMIENMIKEGKIVPSEVTIKLLQQAMIKNENDKFLIDGFPRNEENRAAFENVTKISPAFVLFFNCSEEEMERRLLGRNEGRVDDNIETIRKRFKVFVESSLPVIEYYDAKDKVKKIDAAKPIPEVFEDVKAIFAPYAKAT

SEQ ID NO: 848 - DNA, 1151 bp, Zea mays subsp. mays
  CDS (23)..(877)
gctctacatttctctttctgcaatggcgagattagtgcgtgtggctagatcctcctccctctttggctttggtaaccgtttctactctacttcagccgaagctagccacgcgtcgtcgccttcgccgtttcttcacggcggcggagctagcagggttgctccgaaagatagaaatgttcagtgggtgtttttgggatgtcctggtgttggaaaaggaacttacgctagtagactatcaacccttctcggcgttcctcacatcgccaccggcgatctcgtccgtgaagagcttgcatcttctggacctctctctcaaaagctatcggagattgtaaatcagggaaaattggtttctgatgagatcattgtagacttattgtccaaaagacttgaggctggtgaagctagaggtgaatcagggtttatccttgatggctttcctcgtaccatgagacaagctgaaatactgggagatgtaactgacatcgatttggtggtgaatttgaagcttcctgaggaagttttggttgacaaatgccttggaaggagaacatgtagtcaatgtggcaagggttttaatgtagctcacatcaacttaaagggtgagaatggaagacctggaattagtatggatccacttctccctccacatcaatgtatgtcaaagcttgtcactcgagctgatgatactgaagaggtggtgaaagcaaggcttcgtatatacaatgaaacgagccagcctcttgaagaatactaccgtaccaagggaaagcttatggagtttgacttacctggaggcatcccagagtcatggccaaggctattggaagctttaaggcttgacgattacgaggagaaacagtctgtcgcagcataagttcactatcaaatcccggtatttaaaattctttgcatgtggaatacatatgcgtaatcaattttgtgttggaaataaaagtaaaaagaaaaccttagattgtttttcacctcaatagaaataatcatacacacttgcgcaaactattatttttccaccagccggggattttggctccatgagagaaatatgatgtatcatgattgtttgagattgctagtgacattacaggaatgtatcaatacttctacacctcttgttatgcattgagttt

SEQ ID NO: 849 - protein, 284 aa, Zea mays subsp. mays
MARLVRVARSSSLFGFGNRFYSTSAEASHASSPSPFLHGGGASRVAPKDRNVQWVFLGCPGVGKGTYASRLSTLLGVPHIATGDLVREELASSGPLSQKLSEIVNQGKLVSDEIIVDLLSKRLEAGEARGESGFILDGFPRTMRQAEILGDVTDIDLVVNLKLPEEVLVDKCLGRRTCSQCGKGFNVAHINLKGENGRPGISMDPLLPPHQCMSKLVTRADDTEEVVKARLRIYNETSQPLEEYYRTKGKLMEFDLPGGIPESWPRLLEALRLDDYEEKQSVAA

SEQ ID NO: 850 - DNA, 732 bp, Medicago truncatula
  CDS (1)..(732)
atggcgagctctaacttggaagatgttccttctgttgatctcatgtccgagttacttcgtcgtttcaaatgttcttccaaacctgacaaacgtcttattctcgttggcccacctggatctggaaaaggcacccagtcgccgatcataaaggacgagtactgcttatgccatttggctactggtgatatgttgagagcagctgtagcagctaaaacccctcttggtattaaggcgaaagaagctatggaaaagggagaacttgtttctgatgacttggttgttggcatcattgatgaagcaatgaagaaaccatcatgtcagaaaggtttcattcttgatggttttccaagaactgtggtccaagcacagaagcttgatgagatgctgcagaaacagggtgctaaaattgacaaagtgctcaattttgcaattgatgacgcaatccttgaggagcgaattactggacgctggatacacccatccagtggcagaacctaccatacaaagtttgctcctcccaaggtttctggggttgatgatgttactggtgagcctcttatccagcgcaaggatgacactgcagctgttcttaagtcaagactcgagtcgtttcacaggcaaactgaaccggttattgattactattcgaaaaagggcattgttgctagtctccatgctgaaaaacctcccaaagaggtgacatctgaggtcgagaaagtgctgtctcaatag

SEQ ID NO: 851 - protein, 243 aa, Medicago truncatula
MASSNLEDVPSVDLMSELLRRFKCSSKPDKRLILVGPPGSGKGTQSPIIKDEYCLCHLATGDMLRAAVAAKTPLGIKAKEAMEKGELVSDDLVVGIIDEAMKKPSCQKGFILDGFPRTVVQAQKLDEMLQKQGAKIDKVLNFAIDDAILEERITGRWIHPSSGRTYHTKFAPPKVSGVDDVTGEPLIQRKDDTAAVLKSRLESFHRQTEPVIDYYSKKGIVASLHAEKPPKEVTSEVEKVLSQ

SEQ ID NO: 852 - DNA, 657 bp, Acidovorax sp. JS42
  CDS (1)..(657): transl_table=11
atgagactgattctgctcggcgctcccggcgccggaaagggtacgcaggccgcgttcatctgccagaaattcggcatcccccagatctccaccggcgacatgctgcgcgccgccgtcaaggccggcacgcccctgggcctgcaagccaaggccgtcatggatgcgggccagctcgtcagcgacgacctgatcatcaacctggtgaaggagcgcatcgccgagcccgactgtgcccagggtttcctgttcgacggcttcccacgcaccatcccccaggcagacgccatgaaagccgcgggcgtgaagctcgactatgtgctggagatcgacgtgccgttcgacgccatcatcgagcgcatgagcggccgccgctcccacccggcttcgggccgcacctaccacgtgaagttcaacccgcccaaggtcgaaggcaaggacgacgtgacgggcgagcccctggtgcagcgcgaggacgacaaggaagaaaccgtcaagaagcgcctgcaggtctacagcgaccagacccgcccgctggtggactattactccagctgggccaagaccgatcccgccaacgcccccaagtaccgtgccattcaaggcaccggcagcgtggaggaaatcacccagcgcgccctgacggcgctgtcgagctga

SEQ ID NO: 853 - protein, 218 aa, Acidovorax sp. JS42
MRLILLGAPGAGKGTQAAFICQKFGIPQISTGDMLRAAVKAGTPLGLQAKAVMDAGQLVSDDLIINLVKERIAEPDCAQGFLFDGFPRTIPQADAMKAAGVKLDYVLEIDVPFDAIIERMSGRRSHPASGRTYHVKFNPPKVEGKDDVTGEPLVQREDDKEETVKKRLQVYSDQTRPLVDYYSSWAKTDPANAPKYRAIQGTGSVEEITQRALTALSS

SEQ ID NO: 854 - DNA, 645 bp, Shigella flexneri 2a str. 301
  CDS (1)..(645): transl_table=11
atgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgtaatggtttcctgttggacggcttcccgcgtaccattccgcaggcagacgcgatgaaagaagcgggcatcaatgttgattacgttctggaattcgacgtaccggacgaactgattgttgatcgtatcgtaggccgccgcgttcatgcgccgtctggtcgtgtttatcacgttaaattcaatccgccgaaagtagaaggcaaagacgacgttaccggtgaagaactgactacccgtaaagacgatcaggaagaaaccgtgcgtaaacgtctggttgaataccatcagatgactgcaccgctgatcggctactactccaaagaagcggaagcgggtaacaccaaatacgcgaaagttgacggtaccaagcaggttgctgaagttcgcgctgatctggaaaaaatcctcggctaa

SEQ ID NO: 855 - protein, 214 aa, Shigella flexneri 2a str. 301
MRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKQVAEVRADLEKILG

SEQ ID NO: 856 - DNA, 705 bp, Escherichia coli CFT073
  CDS (1)..(705): transl_table=11
ttggtggtatcgtttatcgctttttcaaaaaattcgacacattttaaggggattttcgcaatgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgcaacggtttcctgttggacggcttcccgcgtaccattccgcaggcagacgcgatgaaagaagcgggcatcaatgttgattacgttctggaattcgacgtaccggacgaactgattgttgaccgtatcgtaggccgccgcgttcacgcgccgtctggtcgtgtttatcacgttaaattcaatccgccgaaagtagaaggcaaagacgacgttaccggtgaagaactgactacccgtaaagacgatcaggaagagaccgtacgtaaacgtctggttgaataccatcagatgactgcaccgctgatcggctactactccaaagaagctgaagcgggtaacaccaaatacgcgaaagttgacggcaccaagccggtggctgaagttcgcgcagctctggaaaaaattctcggctaa

SEQ ID NO: 857 - protein, 234 aa, Escherichia coli CFT073
MVVSFIAFSKNSTHFKGIFAMRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRAALEKILG

SEQ ID NO: 858 - DNA, 645 bp, Colwellia psychrerythraea 34H
  CDS (1)..(645): transl_table=11
atgcgcattgttttattgggtgctccaggcgctggtaaaggcacacaagcacagttcttaatggctaaatttggtattccacagatctcaacaggcgatatgctacgtgctgctattaaagcaggatcggagctaggtaacaaagccaaagccgtaatggatgctggtcaattagtttctgacgatttaatcatcggattagttaaagagcgagtagctcaagaagattgtaaagctggttttttacttgatggctttcctcgcacaataccacaagcagatgcaatgaaagaaagtggtattgttgttgaccatgttcttgaatttgatgtaccagatgaagtcattgttgaacgtatggctggccgtcgtgtacattctggctcaggtcgtgtttatcaccttgtttataacccaccaaaggttgaaggcaaagatgatgtaagtggtgacgatttatccattcgtccagatgatgaagaagcgacagtgcgtaagcgtttagctatttaccacgagcaaactaagccattggtagatttctatcaagcagaagctaaatcaggtagctgtagttatttaactattgatggcacacaagccgttgaaaaagttaaccaattattatcagctcaactggcttaa

SEQ ID NO: 859 - protein, 214 aa, Colwellia psychrerythraea 34H
MRIVLLGAPGAGKGTQAQFLMAKFGIPQISTGDMLRAAIKAGSELGNKAKAVMDAGQLVSDDLIIGLVKERVAQEDCKAGFLLDGFPRTIPQADAMKESGIVVDHVLEFDVPDEVIVERMAGRRVHSGSGRVYHLVYNPPKVEGKDDVSGDDLSIRPDDEEATVRKRLAIYHEQTKPLVDFYQAEAKSGSCSYLTIDGTQAVEKVNQLLSAQLA

SEQ ID NO: 860 - DNA, 663 bp, Burkholderia thailandensis E264
  CDS (1)..(663): transl_table=11
atgcgtttgatcctgttgggcgcgcccggcgcgggaaagggcacccaggcaaacttcatcaaggaaaagttcggcattccgcaaatctcgacgggcgacatgctgcgcgccgccgtgaaggccggcacgccgctcggcgtcgaagcgaaggcgtacatggatgaaggcaagctcgtgccggattcgctgatcatcggcctcgtcaaggagcgcctgaaggaagcggactgcgcgaacggctacctgttcgacggcttcccgcgcacgatcgcgcaggccgacgcgatgaaggaagcgggcgtcgcgatcgactacgtgctcgagatcgacgtgccgttctcggaaatcatcgagcggatgagcggccgccgcacgcacccggcgtcgggacgcacgtaccacgtgaagttcaacccgccgaaggtcgagggcaaggacgacgtgacgggcgagccgctgattcagcgcgacgacgacaaggaagaaacggtgaagaagcgcctcgacgtgtacgaagcgcagacgaagccgctcatcacgtattacggcgactgggcgacgcgcggcgaggagaacggcctgaaggcgcccgcgtaccggaagatctccggcctcggcgccgtcgacgaaatccgcgcgcgcgtgttcgacgcgctgaagtga

SEQ ID NO: 861 - protein, 220 aa, Burkholderia thailandensis E264
MRLILLGAPGAGKGTQANFIKEKFGIPQISTGDMLRAAVKAGTPLGVEAKAYMDEGKLVPDSLIIGLVKERLKEADCANGYLFDGFPRTIAQADAMKEAGVAIDYVLEIDVPFSEIIERMSGRRTHPASGRTYHVKFNPPKVEGKDDVTGEPLIQRDDDKEETVKKRLDVYEAQTKPLITYYGDWATRGEENGLKAPAYRKISGLGAVDEIRARVFDALK

SEQ ID NO: 862 - DNA, 666 bp, Burkholderia xenovorans LB400
  CDS (1)..(666): transl_table=11
atgcgtttgattcttttgggtgcgcccggcgcaggtaagggcactcaggccaccttcatcaaggaaaagttcggcattccgcaaatttccaccggtgacatgctgcgcgcagccgttaaagccggcacgccgctcggccttgaagccaagcgcttcatggacgctggtgaactggtcacggacgaactgatcatcaatctggtgaaagaacgtctgcagcagccggactgcgcgaacggctatctgttcgacggttttccgcgcaccattccgcaggccgaggccatgaagcaggccggcgtcgcgatcgactacgtgctggagatcgacgtgccgttcgaggagatcatcgtgcggatgagcggccgccgctcgcacgccgcgtcgggccgtacgtaccacgtcaagttcaatccgccgaaggttgaaggcctggacgacgtgaccggagaaccgctgatccagcgcgacgacgacaaggaagaaacagtcaagaagcgtctggaagtgtatgaggcgcagaccaagccgttgatcgagtactacaccaactgggcgaagaacggcgattcgtcgaccccgttgaaggcgccgcagtatcgccgcatttcgggcctcggcagcgtcgatgaaattcgtgaacgcgcgtttgaggcgttgaagtaa

SEQ ID NO: 863 - protein, 221 aa, Burkholderia xenovorans LB400
MRLILLGAPGAGKGTQATFIKEKFGIPQISTGDMLRAAVKAGTPLGLEAKRFMDAGELVTDELIINLVKERLQQPDCANGYLFDGFPRTIPQAEAMKQAGVAIDYVLEIDVPFEEIIVRMSGRRSHAASGRTYHVKFNPPKVEGLDDVTGEPLIQRDDDKEETVKKRLEVYEAQTKPLIEYYTNWAKNGDSSTPLKAPQYRRISGLGSVDEIRERAFEALK

SEQ ID NO: 864 - DNA, 645 bp, Haemophilus somnus 129PT
  CDS (1)..(645): transl_table=11
atgaaaatcattcttttgggggcacctggtgcaggcaaaggtactcaagcacaatttattacaaataagtttggcattcctcaaatttctactggtgatatgctacgtgctgcaattaaagctggaagtgaattgggacaaaaggctaaaatcttaatggatatgggacaattggtacctgatgatttgattatttctttggtgaaagaacgtgtagcacaagaagattgcgagaaaggttttttactggacggtttcccacgtacaattccacaagcagacgctttaaaatccgttggtatcagtattgattatgtattggaatttgatgtgccggatgaagttattgttgagcgtatgagtggtcgtcgtgttcaccctgcttctggacggacttatcacattgtttacaacccgccaaaagtggaagataaagatgatataaccggtgaagatttaattcttcgtgcagatgataaacctgaaactgttctagatcgtttaaaaatttatcataataccactaaacttttggttgattattatcaagctgaagctgcacaaggtaacacgaaatactttcgattagatggtacacaaaaagttgaagaagtgagtcaagaactggacaagatcttgagctaa

SEQ ID NO: 865 - protein, 214 aa, Haemophilus somnus 129PT
MKIILLGAPGAGKGTQAQFITNKFGIPQISTGDMLRAAIKAGSELGQKAKILMDMGQLVPDDLIISLVKERVAQEDCEKGFLLDGFPRTIPQADALKSVGISIDYVLEFDVPDEVIVERMSGRRVHPASGRTYHIVYNPPKVEDKDDITGEDLILRADDKPETVLDRLKIYHNTTKLLVDYYQAEAAQGNTKYFRLDGTQKVEEVSQELDKILS

SEQ ID NO: 866 - DNA, 645 bp, Shewanella sp. MR-4
  CDS (1)..(645): transl_table=11
atgcgcattatcctattgggcgccccaggtgccggtaaaggtacccaggcccagttcattatggaacagtatggtatcccacaaatttctactggcgacatgttacgtgctgccgttaaagccggtactccgctgggtttagaagcgaagaaagtgatggatgcaggccaactggtttctgatgatctgatcattggactggttaaagagcgtatcgcacaggacgactgtgttaaaggtttcctgttagacggtttcccacgcactatcccacaagcggatgcgatggcggcaaacggtatcagcattgatcacgtgatcgaaatcgatgtgccagacgaagaaatcgttaagcgcatgagcggtcgtcgcgttcacccaggttctggccgtgtttaccacgtggtattcaatccacctaaagtggaaggcaaggacgatgtaacaggcgaagacttagcgattcgtccagatgacgaagaagccacagtacgtaagcgtttaggcatttaccacgagcaaactaagccattggttgaatactatggcaaagtagctgcggcgggtaacactcaataccacaaatttgatggtactcagtcggtagcggctgtgagtgcacaattagccagcgtgctgaaataa

SEQ ID NO: 867 - protein, 214 aa, Shewanella sp. MR-4
MRIILLGAPGAGKGTQAQFIMEQYGIPQISTGDMLRAAVKAGTPLGLEAKKVMDAGQLVSDDLIIGLVKERIAQDDCVKGFLLDGFPRTIPQADAMAANGISIDHVIEIDVPDEEIVKRMSGRRVHPGSGRVYHVVFNPPKVEGKDDVTGEDLAIRPDDEEATVRKRLGIYHEQTKPLVEYYGKVAAAGNTQYHKFDGTQSVAAVSAQLASVLK

SEQ ID NO: 868 - DNA, 645 bp, Actinobacillus pleuropneumoniae serovar 1 str. 4074
  CDS (1)..(645): transl_table=11
atgaaaattattcttttaggtgcgccgggtgcaggtaaaggcacgcaagcacaatttatgatgaacaaattcggtattccgcaaatctcaaccggcgatatgttccgtgcggcaattaaagaaggcacggagcttggtaaacaagcaaaagcgttaatggacgaaggtaaattagtaccggacgaattaaccgttgcattagttaaagatcgtatcgcacaaccggattgcgcaaacggcttcttattagacggtttccctcgcacgattccgcaagcggacgcattaaaagattcgggtgtgaaaattgatttagtcttagagtttgatgtcgcggacgaagtgattgttgaacgtatgagcggtcgtcgtgtacaccagccttccggtcgtacttatcacgtggtttacaacccgccgaaagtggaaggcaaagatgatgtaaccggtgaagatttaattattcgccaagatgataaacctgaaaccgtattagaacgtttagcgatttatcacaaacaaaccaagccgttaattgcttactatacggcggaagcggaagcgggtaatacgcgttacgagcgtttagacggtacaaaaccggttgaagaagtgagtgcggaattagcgaaaattttaggttaa

SEQ ID NO: 869 - protein, 214 aa, Actinobacillus pleuropneumoniae serovar 1 str. 4074
MKIILLGAPGAGKGTQAQFMMNKFGIPQISTGDMFRAAIKEGTELGKQAKALMDEGKLVPDELTVALVKDRIAQPDCANGFLLDGFPRTIPQADALKDSGVKIDLVLEFDVADEVIVERMSGRRVHQPSGRTYHVVYNPPKVEGKDDVTGEDLIIRQDDKPETVLERLAIYHKQTKPLIAYYTAEAEAGNTRYERLDGTKPVEEVSAELAKILG

SEQ ID NO: 870 - DNA, 645 bp, Haemophilus influenzae R2846
  CDS (1)..(645): transl_table=11
atgaaaattattcttttaggtgcaccgggtgcaggtaaaggcactcaagcacaatttattatgaacaaatttggtatcccgcaaatttcaactggtgatatgttccgtgctgcaatcaaagcggggactgaacttggcaaacaagctaaagcattaatggatgaaggtaaattagtgccagatgaattaaccgttgcccttgtaaaagatcgtattgctcaagctgactgtgcaaatggtttcttgttagatggtttccctcgtactattccacaagcggatgcactgaaagattcaggtgttaaaattgactttgttttagagtttgatgtgccagacgaagtgattgttgaacgtatgagtggccgtcgcgtacaccaagcgtctggtcgttcttaccatatcgtttataatccaccaaaagtggaaggtaaggatgatgtaactggtgaagatttaattattcgtgcagacgataaaccagaaactgtattagatcgtttagccgtatatcataaacaaaccagcccattaattgattattaccaagcagaagcgaaagcggggaatactcaatatttccgtttagacggtacacaaaaagtagaagaagttagccaagagttagataaaatcttaggctaa

SEQ ID NO: 871 - protein, 214 aa, Haemophilus influenzae R2846
MKIILLGAPGAGKGTQAQFIMNKFGIPQISTGDMFRAAIKAGTELGKQAKALMDEGKLVPDELTVALVKDRIAQADCANGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKAGNTQYFRLDGTQKVEEVSQELDKILG

SEQ ID NO: 872 - DNA, 663 bp, Burkholderia vietnamiensis G4
  CDS (1)..(663): transl_table=11
atgcgtttgatcctgttgggcgcgcccggcgcgggaaagggcacccaggcaaacttcatcaaggaaaaattcggcatcccgcaaatctcgacgggtgacatgctgcgtgcggccgtcaaggccggctcgccgctcggcgtcgaggcgaagggctacatggatgccggcaagctcgtccccgacgcgctgatcatcggcctcgtgaaggaacgcctgaaggaatccgattgcgcgaacggctacctgttcgacggcttcccgcgcacgatcgcgcaggccgacgcgatgaaggaagccggcgtcgcgatcgactacgtgctcgaaatcgacgtgccgttctcggaaatcgtcgagcgcatgagcggtcgtcgcacgcacgcggcatcgggccgcacctaccacgtgaagttcaatccgccgaaggtcgaaggccaggacgacgtgacgggcgagccgctgatccagcgcgacgacgacaaggaagaaaccgtcaagaagcgcctcgaagtgtacgaagcgcagaccaagccgctgatcacgtattacggcgactgggcgcagcgcggcgaggaaaacggcctgaaggcgccgcagtatcggaagatctcgggcctcggcagcgtcgaggaaatccgcgagcgtgcgttcgaagcgctgaagtaa

SEQ ID NO: 873 - protein, 220 aa, Burkholderia vietnamiensis G4
MRLILLGAPGAGKGTQANFIKEKFGIPQISTGDMLRAAVKAGSPLGVEAKGYMDAGKLVPDALIIGLVKERLKESDCANGYLFDGFPRTIAQADAMKEAGVAIDYVLEIDVPFSEIVERMSGRRTHAASGRTYHVKFNPPKVEGQDDVTGEPLIQRDDDKEETVKKRLEVYEAQTKPLITYYGDWAQRGEENGLKAPQYRKISGLGSVEEIRERAFEALK

SEQ ID NO: 874 - DNA, 645 bp, Pseudoalteromonas tunicata D2
  CDS (1)..(645): transl_table=11
atgcgcattattcttttgggcgcaccaggtgcgggtaaaggtactcaagctcaatttctgatggaaaaattttcgattccacagatttctacgggcgatatgttacgtgctgcaattaaagaaggcacaccacttggtttagaagccaaaaaagtgatggatgcaggtcaattgatttctgatgatatcatcattggtcttgttaaagagcgtattgctaaagctgattgtgaaaaaggctttttgttagacggtttcccacgcactattccacaagcagatgcaatgaaagaaaatggcgttgttgttgatcacgttattgaatttgatgttgctgatgaagtgattgttgagcgtatggctggacgtcgtgttcacccaggttcaggccgtgtttatcatgttgtttataatccttcaaaagttgaaggtaaagatgatgtaaccggtgaagacttgatcattcgtgatgatgatgttgaagaaacagtgcgtaaacgtttaggtatttaccatgaccaaactaagccacttgtcagctattatcaggcagaagctgatgcgggcaatactcagtaccataaattagatggtacacaagctgttgatgcggtaagcgcccaattagctgagttattagggtaa

SEQ ID NO: 875 - protein, 214 aa, Pseudoalteromonas tunicata D2
MRIILLGAPGAGKGTQAQFLMEKFSIPQISTGDMLRAAIKEGTPLGLEAKKVMDAGQLISDDIIIGLVKERIAKADCEKGFLLDGFPRTIPQADAMKENGVVVDHVIEFDVADEVIVERMAGRRVHPGSGRVYHVVYNPSKVEGKDDVTGEDLIIRDDDVEETVRKRLGIYHDQTKPLVSYYQAEADAGNTQYHKLDGTQAVDAVSAQLAELLG

SEQ ID NO: 876 - DNA, 645 bp, Photobacterium sp. SKA34
  CDS (1)..(645): transl_table=11
atgcgcatcattcttctgggcgctccaggtgcaggtaaaggtactcaagctcaattcattatggaaaagtttggtattcctcaaatttcaactggtgacatgctacgtgctgcaatcaaagcaggtactgagctaggcaaacaagcgaaatcagtgatcgatgcaggtcaattggtatctgacgatatcattcttggtcttgtaaaagagcgtattgcggcagatgattgtgcaaaaggcttcctactagatggtttcccacgcacaattcctcaagctgatggcctaaaagaaaacggcgttaacgttgattacgttatcgagtttgatgtggctgacgatgtgatcgttcagcgtatggcgggtcgtcgtgctcaccttgcttctggtcgtacttaccacgctgtttataacccaccaaaggttgaaggtaaagatgacgtaacaggcgaagagcttgttatccgtgaagatgacaaagaagaaacagttcgtgcacgtctaaacgtatatcacacgcaaactgcaccacttatcgagtactacggtaaagaagcagaagcaggcaacactaagtaccttaagttcgacggtacactccctgttgctgaagttagcgctgcgctagaaaaagcattagcttaa

SEQ ID NO: 877 - protein, 214 aa, Photobacterium sp. SKA34
MRIILLGAPGAGKGTQAQFIMEKFGIPQISTGDMLRAAIKAGTELGKQAKSVIDAGQLVSDDIILGLVKERIAADDCAKGFLLDGFPRTIPQADGLKENGVNVDYVIEFDVADDVIVQRMAGRRAHLASGRTYHAVYNPPKVEGKDDVTGEELVIREDDKEETVRARLNVYHTQTAPLIEYYGKEAEAGNTKYLKFDGTLPVAEVSAALEKALA

SEQ ID NO: 878 - DNA, 660 bp, Oceanospirillum sp. MED92
  CDS (1)..(660): transl_table=11
atgcgtattatccttctgggcgcaccaggcgcaggtaaaggtactcaggcacagtacatttgtgaaaagtacaacattccacagatctctactggcgatatgctgcgtgccgcggtaaaagcgggtaccccgctgggcgtaaaagcaaaagaagttatggatgcgggccagttggtttccgatgacattatcatcggtctggtaaaagagcgtattgctgaagcagattgtgcaaatggtttcctgtttgatggtttcccacgtacgattcctcaggcagatgcgctgaaagatgcaggtgtaaagatcgatgcggttgctgagatcgatgtagcggatgaagagattgttaagcgtatggcaggccgccgtgtgcacccaggttctggccgtacttaccacgttgtattcaatccgcctaaagttgaaggtaaggatgatgtgacgggtgaagatctggttcagcgcgctgatgatgctgaagataccgtacgtgaccgtctgaaagtttaccatgaccagacagctcctctgattacttactacaagggctgggctgaagaagatgcagctgctgcaccttcttacgtttatgtacctggcgtaggttctgtcgaagatattcgcgatgcggtatttgcaggtctggaaaacgcttaa

SEQ ID NO: 879 - protein, 219 aa, Oceanospirillum sp. MED92
MRIILLGAPGAGKGTQAQYICEKYNIPQISTGDMLRAAVKAGTPLGVKAKEVMDAGQLVSDDIIIGLVKERIAEADCANGFLFDGFPRTIPQADALKDAGVKIDAVAEIDVADEEIVKRMAGRRVHPGSGRTYHVVFNPPKVEGKDDVTGEDLVQRADDAEDTVRDRLKVYHDQTAPLITYYKGWAEEDAAAAPSYVYVPGVGSVEDIRDAVFAGLENA

SEQ ID NO: 880 - DNA, 645 bp, Vibrio sp. Ex25
  CDS (1)..(645): transl_table=11
atgcgcatcattcttctaggtgctccaggtgcaggtaaaggcacacaagcaaacttcatcatggaaaaatacggtattccacaaatctctactggtgatatgcttcgtgctgctatcaaagcaggtacagagcttggtaaacaagctaaagctgttatcgacgctggtcagctagtttctgatgaaatcatccttggccttatcaaagagcgtatcgctcaagaagactgtgcgaacggtttcctactggatggtttcccacgtactattcctcaagctgacggcctaaaagaaatgggcgttgatgtagactacgttatcgaatttgacgttgcagatgatgtgattgttgagcgtatggcaggtcgtcgtgctcaccttccttctggtcgtacttaccacgttgtttacaacccacctaaagtggaaggtaaagatgacgtaactggtgaagatcttgttgttcgtgatgacgacaaagaagaaacagtacgtgcacgtctaggtgtttaccacgagcaaactgcaccactaatcaactactacggtaaagaagctgaagcaggcaacactaagtaccttaagtttgatggtactaagcaagtagctgaagttagtgcagatatcgagaaagcactctcttaa

SEQ ID NO: 881 - protein, 214 aa, Vibrio sp. Ex25
MRIILLGAPGAGKGTQANFIMEKYGIPQISTGDMLRAAIKAGTELGKQAKAVIDAGQLVSDEIILGLIKERIAQEDCANGFLLDGFPRTIPQADGLKEMGVDVDYVIEFDVADDVIVERMAGRRAHLPSGRTYHVVYNPPKVEGKDDVTGEDLVVRDDDKEETVRARLGVYHEQTAPLINYYGKEAEAGNTKYLKFDGTKQVAEVSADIEKALS

SEQ ID NO: 882 - DNA, 645 bp, Alteromonadales bacterium TW-7
  CDS (1)..(645): transl_table=11
atgcgcattattcttttgggcgcgccgggtgcaggtaaaggtactcaagctcagtttttaatggacaagtacggtattccacaaatttcaactggcgatatgctacgtgctgcaattaaagaaggcactccacttggcttagaagcaaaaaaagtaatggacgcaggtcagctaatttctgacgatatcattattggtttagttaaagagcgtattgctaaagctgattgcgaaaaaggttttttactagatggctttccacgtaccattccacaagcagatgcaatgaaagaaaatggcgtagtagttgatcacgttattgaatttgatgttgctgatgaagtaattgtagagcgtatgggcggacgtcgtgttcatcctggctcgggccgtgtttatcatgttgtttacaatccaccaaaagtggaaggtaaagatgatgaaacaggtgaagagttaattgtgcgcgctgacgacacagaagagactgtgcgtaaacgtctaggtatttaccatgagcaaactatgccgttggttgattactaccaagctgaagccgctgcaggcaacacgcagtaccataaacttgacggtacacaagccgtagaagttgtaagtgctcagttaggtgagcttttgggttaa

SEQ ID NO: 883 - protein, 214 aa, Alteromonadales bacterium TW-7
MRIILLGAPGAGKGTQAQFLMDKYGIPQISTGDMLRAAIKEGTPLGLEAKKVMDAGQLISDDIIIGLVKERIAKADCEKGFLLDGFPRTIPQADAMKENGVVVDHVIEFDVADEVIVERMGGRRVHPGSGRVYHVVYNPPKVEGKDDETGEELIVRADDTEETVRKRLGIYHEQTMPLVDYYQAEAAAGNTQYHKLDGTQAVEVVSAQLGELLG

SEQ ID NO: 884 - DNA, 663 bp, Burkholderia mallei
  CDS (1)..(663): transl_table=11
atgcgtttgatcctgttgggcgcgcccggcgcgggaaagggcacccaggcaaacttcatcaaggagaagttcggcatcccgcaaatctcgacgggcgacatgctgcgtgccgccgtgaaggccggcacgccgctcggcgtcgaggcgaagacgtacatggacgaaggcaagctcgtgccggattcgctgatcatcggcctcgtcaaggaacgtctgaaggaagcggactgcgcgaacggctatctgttcgacggcttcccgcgcacgatcgcgcaggccgacgcgatgaaggaagcgggcgtcgcgatcgactacgtgctggagatcgacgtgccgttctcggaaatcatcgaacgcatgagcggccgccgcacgcatccggcgtcgggccgcacgtatcacgtgaagttcaacccgccgaaggtcgagggcaaggacgacgtcacaggcgagccgctggtccagcgcgacgacgacaaggaagagacggtgaagaaacgcctcgacgtgtacgaggcgcagacgaagccgctcatcacgtactacggcgactgggcgcggcgcggcgcggaaaacggcctgaaggcgcccgcttaccggaagatctccggcctcggcgccgtcgaggaaatccgcgcgcgcgtgttcgacgcgctgaagtga

SEQ ID NO: 885 - protein, 220 aa, Burkholderia mallei
MRLILLGAPGAGKGTQANFIKEKFGIPQISTGDMLRAAVKAGTPLGVEAKTYMDEGKLVPDSLIIGLVKERLKEADCANGYLFDGFPRTIAQADAMKEAGVAIDYVLEIDVPFSEIIERMSGRRTHPASGRTYHVKFNPPKVEGKDDVTGEPLVQRDDDKEETVKKRLDVYEAQTKPLITYYGDWARRGAENGLKAPAYRKISGLGAVEEIRARVFDALK

SEQ ID NO: 886 - DNA, 657 bp, Chromobacterium violaceum
  CDS (1)..(657): transl_table=11
atgcgattgatcctgttgggcgcgcccggcgccggcaaaggcacccaggccaactacatccgcgagaagttcggcatcccgcagatctccaccggcgacatgctgcgcgccgcggtcaaggccggcaccccgctgggcctggaagccaaggccatcatggatgccggcggcctggtccgcgacgacatcatcatcggcctggtcaaggagcgaatcgcccaggacgactgcgccaacggcttcctgttcgacggcttcccgcgcaccattccgcaggcggaagcgatgatcgccgccggcgtcgacatcgactacgtggtggagatcgacgtgccggacgccgccatcgtcgagcgcatggccggccgccgcgtgcacctggcttcgggccgcacctaccatgtcaccttcaacccgcccaaagcggccggcaaggacgacgtgaccggcgaggacctggtccagcgcgacgacgacaaggaagaaaccgtgaagaagcgcctggctgtctaccacgagcagaccgccgtgctggtgggcttctacggcaagctggccgagagcggcagcgccaaggcgccgaagtacgtgaagatcgacggcacccgcgcggtggaaaccgtgcgcgacgacgtgctgaaggcgctgggcgcctga

SEQ ID NO: 887 - protein, 218 aa, Chromobacterium violaceum
MRLILLGAPGAGKGTQANYIREKFGIPQISTGDMLRAAVKAGTPLGLEAKAIMDAGGLVRDDIIIGLVKERIAQDDCANGFLFDGFPRTIPQAEAMIAAGVDIDYVVEIDVPDAAIVERMAGRRVHLASGRTYHVTFNPPKAAGKDDVTGEDLVQRDDDKEETVKKRLAVYHEQTAVLVGFYGKLAESGSAKAPKYVKIDGTRAVETVRDDVLKALGA

SEQ ID NO: 888 - DNA, 645 bp, Escherichia coli O6
  CDS (1)..(645): transl_table=11
atgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgcaacggtttcctgttggacggcttcccgcgtaccattccgcaggcagacgcgatgaaagaagcgggcatcaatgttgattacgttctggaattcgacgtaccggacgaactgattgttgaccgtatcgtaggccgccgcgttcacgcgccgtctggtcgtgtttatcacgttaaattcaatccgccgaaagtagaaggcaaagacgacgttaccggtgaagagctgactacccgtaaagacgatcaggaagagaccgtacgtaaacgtctggttgaataccatcagatgactgcaccgctgatcggctactactccaaagaagcggaagcgggtaacaccaaatacgcgaaagttgacggcaccaagccggtggctgaagttcgcgcagctctggaaaaaattctcggctaa

SEQ ID NO: 889 - protein, 214 aa, Escherichia coli O6
MRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRAALEKILG

SEQ ID NO: 890 - DNA, 645 bp, Erwinia carotovora subsp
  CDS (1)..(645): transl_table=11
atgcgtattattctgctgggcgctccgggcgcaggcaaaggtactcaggctcaattcatcatgggaaaatacggtattccgcagatttccacgggtgacatgctgcgtgcagcggtaaaagccggtactgaattgggcaagcaggctaaagaaatcatggacgcgggtaaactggtcactgatgaactggtcattgctctggttaaagagcgcattgcacaggacgattgccgtaacggttttctactggatggcttcccacgcaccattccgcaggctgatgctatgaaagatgctggcatcgatgtggactacgtcatcgaattcgcagttcctgacgaactgatcatcgatcgtatcattggtcgtcgcgttcatgcggcgtccggtcgtgtttatcacgtaaaatttaatccgcctaaagttgaagacaaagacgatgtgaccggcgaagacctgagcgttcgtaaggacgatcaggaagataccgtgcgtaaacgtctggttgaatatcatcagcagactgcgccactggtttcttactatcagaaagaagctgacgcgggtaatacgcgctatttcaaagtggaaggcacgcgtaaagtagaagaagttcgcgcagaactggaaaccattctgggctag

SEQ ID NO: 891 - protein, 214 aa, Erwinia carotovora subsp
MRIILLGAPGAGKGTQAQFIMGKYGIPQISTGDMLRAAVKAGTELGKQAKEIMDAGKLVTDELVIALVKERIAQDDCRNGFLLDGFPRTIPQADAMKDAGIDVDYVIEFAVPDELIIDRIIGRRVHAASGRVYHVKFNPPKVEDKDDVTGEDLSVRKDDQEDTVRKRLVEYHQQTAPLVSYYQKEADAGNTRYFKVEGTRKVEEVRAELETILG

SEQ ID NO: 892 - DNA, 648 bp, Haemophilus ducreyi
  CDS (1)..(648): transl_table=11
atgaaagttatcctattaggtgcacccggcgcaggtaaaggcacacaagcacaattcattatgcataaatttggtatcccacaaatttcaacgggtgatatgttccgtgcagcaattaaagaaggaacagaattaggtaaacaagcaaaagcattaatggatcaaggaaaattagtgcctgatgatttaacggttgcattagtaaaagatcgtatcgctcaaccagattgcgcccatggctttttattagatggtttcccacgtactattccacaagccgatgcattaaaagatgccggtgtaaaaattgatttagttctagaatttgatgttgctgacgaagttattgtagaacggatgagtggccgccgtgttcatcaaccatcagggcgaacataccatatcatatacaatccacctaaagtagcaggtcaagatgatattactggcgaagaattaatcacccgtgctgatgataaagccgaaacggtattagaacgtttagccgtatatcatcaacaaacgaaaccgcttatcgcttactatattgctgaagccgaaaaaggcaatacgcgctatgagcgtttagatggcactaaaccggttgagcaagtcagcgctgaattagctaatattttcaaccaataa

SEQ ID NO: 893 - protein, 215 aa, Haemophilus ducreyi
MKVILLGAPGAGKGTQAQFIMHKFGIPQISTGDMFRAAIKEGTELGKQAKALMDQGKLVPDDLTVALVKDRIAQPDCAHGFLLDGFPRTIPQADALKDAGVKIDLVLEFDVADEVIVERMSGRRVHQPSGRTYHIIYNPPKVAGQDDITGEELITRADDKAETVLERLAVYHQQTKPLIAYYIAEAEKGNTRYERLDGTKPVEQVSAELANIFNQ

SEQ ID NO: 894 - DNA, 645 bp, Haemophilus influenzae
  CDS (1)..(645): transl_table=11
atgaaaattattcttttaggtgcaccgggtgcaggtaaaggcactcaagcacaatttattatgaacaaatttggtatcccgcaaatttcaactggtgatatgttccgtgctgcaatcaaagcggggactgaacttggcaaacaagctaaagcattaatggatgaaggtaaattagtgccagatgaattaaccgttgcccttgtaaaagatcgtattgctcaagctgactgcacaaatggtttcttgttagatggtttccctcgtactattccacaagcggatgcactgaaagattcaggtgttaaaattgactttgttttagaatttgatgtgccagacgaagtgattgttgaacgtatgagtggccgtcgcgtacaccaagcgtctggtcgttcttaccatatcgtttataatccaccaaaagtggaaggtaaggatgatgtaacaggcgaagatttaattattcgtgcagacgataaaccagaaactgtattagatcgtttagccgtatatcataaacaaactagcccattaattgattattaccaagcagaagcgaaagcggggaatactcaatatttccgtttagacggtacacaaaaagtggaagaagttagccaagagttagataaaatcttaggctaa

SEQ ID NO: 895 - protein, 214 aa, Haemophilus influenzae
MKIILLGAPGAGKGTQAQFIMNKFGIPQISTGDMFRAAIKAGTELGKQAKALMDEGKLVPDELTVALVKDRIAQADCTNGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKAGNTQYFRLDGTQKVEEVSQELDKILG

SEQ ID NO: 896 - DNA, 657 bp, Mannheimia succiniciproducens
  CDS (1)..(657): transl_table=11
atggagatttctatgaaaattattcttttaggcgcaccgggcgcaggcaaaggaacacaagctcaatttatcatgaacaaattcggtatcccgcaaatctcaacgggggatatgttccgcgccgcaatcaaagcgggcaccgaattaggtaaacaagctaaagcattaatggatgaaggcaaattagtgcctgacgaattaaccgtcgccctggttaaagaccgtattgcccaaccggattgtgccaacggtttcttattagacggtttcccgcgcaccattccgcaagcggatgcgttaaaagactcgggcgtgaacattgattacgtattagaattcgacgtgccggacgaagtgattgtagagcgcatgagcggtcgccgcgtgcaccaggcctccggtcgttcatatcatatcgtttataacccgccgaaggtggaaggcaaagacgatgtgaccggcgaagatttaattatccgcgccgacgacaaaccggaaaccgttttggatcgtttagcggtttatcacaaacaaacccagcctttggttgactactatcaagcggaagctaatgcaggcaacaccaaatacttccgtttagacggcaccaaaaaagtagaagaagtgagtgccgaattaaattccattttaggttaa

SEQ ID NO: 897 - protein, 218 aa, Mannheimia succiniciproducens
MEISMKIILLGAPGAGKGTQAQFIMNKFGIPQISTGDMFRAAIKAGTELGKQAKALMDEGKLVPDELTVALVKDRIAQPDCANGFLLDGFPRTIPQADALKDSGVNIDYVLEFDVPDEVIVERMSGRRVHQASGRSYHIVYNPPKVEGKDDVTGEDLIIRADDKPETVLDRLAVYHKQTQPLVDYYQAEANAGNTKYFRLDGTKKVEEVSAELNSILG

SEQ ID NO: 898 - DNA, 645 bp, Pasteurella multocida
  CDS (1)..(645): transl_table=11
atgaaaattatcctattaggtgcaccgggtgcggggaaagggacacaagcgcaatttattatgaataaatttggcattccacaaatttcaacgggtgatatgttgcgtggtgcaatcaaagcagggacagacttaggtaaacaagcaaaaaccttaatggatgcgggtcaattagtgccagatgatttaatcatttcattagtgaaagaacgtgttgcacaagccgattgtgccaaaggtttcttattagacggcttcccacgcaccattccacaagcggatgcattaaaaacagtcggtatccaaattgactacgttttagagtttgatgtgcctgatgaagtgatcgtagaacgtatgagtggtcgccgtgtacaccaagcctcaggtcgtacttatcacgtcgtttacaacccaccaaaagtagaagggaaagatgacgtgactggcgaagacttaatcatccgtgccgatgataaacctgaaactgtattagatcgcttaaaagtgtatcactccaccacgaaaccattagtggactactaccaagcagaagcgaaagcgggtaacaccaagtacttccgcttagacgggacgaaaaaagtggaagaagtgagtcaagaattagatactattttagcgtaa

SEQ ID NO: 899 - protein, 214 aa, Pasteurella multocida
MKIILLGAPGAGKGTQAQFIMNKFGIPQISTGDMLRGAIKAGTDLGKQAKTLMDAGQLVPDDLIISLVKERVAQADCAKGFLLDGFPRTIPQADALKTVGIQIDYVLEFDVPDEVIVERMSGRRVHQASGRTYHVVYNPPKVEGKDDVTGEDLIIRADDKPETVLDRLKVYHSTTKPLVDYYQAEAKAGNTKYFRLDGTKKVEEVSQELDTILA

SEQ ID NO: 900 - DNA, 645 bp, Photorhabdus luminescens subsp
  CDS (1)..(645): transl_table=11
atgcgtatcattctgctgggcgctccgggcgccggtaaagggactcaggcgcaatttatcgtggagaaatatgggatccctcaaatttctactggcgatatgttgcgttctgcggttaaggctggcacagaattgggtttaaaagcaaaagcgctgatggatcatggtaagctggttactgatgaactggttattgctttggtcaaagagcgcatcaaacaagatgactgccgcaatggtttcttgttggatgggttcccccgtactattccccaagctgatgcgatgaaagaagcgggcattaatgttgattatgttctggaattcgatgttcccgatgaactgattattgaacgtatcattgggcgccgtatacatgcgccatccggccgtgtttatcacatcaaatttaatccaccggtagtggaaaacaaggatgatgttacaggtgaagagctgacagttcgtaaagacgatcacgaagatatcgtgcgtaaacgtttagttgaataccatcagcagacagcacctttagtatcctactatcaaaaagaagcagaagcagattataccaaatattttggaattgatggtactcgtaaggtatctgagattagtgaagaattatctaaaattttggattaa

SEQ ID NO: 901 - protein, 214 aa, Photorhabdus luminescens subsp
MRIILLGAPGAGKGTQAQFIVEKYGIPQISTGDMLRSAVKAGTELGLKAKALMDHGKLVTDELVIALVKERIKQDDCRNGFLLDGFPRTIPQADAMKEAGINVDYVLEFDVPDELIIERIIGRRIHAPSGRVYHIKFNPPVVENKDDVTGEELTVRKDDHEDIVRKRLVEYHQQTAPLVSYYQKEAEADYTKYFGIDGTRKVSEISEELSKILD

SEQ ID NO: 902 - DNA, 645 bp, Photobacterium profundum
  CDS (1)..(645): transl_table=11
atgcgcatcattcttctgggcgctccaggtgcaggtaaaggtacacaggcacaattcatcatggcgaagtttggtattccacaaatttctactggtgacatgttacgcgcagcgatcaaagcgggtactgagctaggtaaacaagcgaagtcagttattgacgctggtcagttggtgtctgatgatatcattcttggtctggttaaagagcgtattgcccaagacgattgtgcaaaaggtttcttacttgatggcttccctcgtacaattcctcaggctgatggcttgaaagaagtgggcgttgtggttgattacgtcatcgaattcgacgttgctgacagtgtaattgttgagcgtatggcgggtcgtcgtgcccatcttgcatcaggtcgtacttaccataatgtttacaacccaccaaaggttgaaggcaaagatgacgtaactggcgaagatcttgttatccgtgaagatgacaaagaagaaacagtgcttgctcgtttaggtgtataccacaaccaaacggcaccattgattgcttactacggtaaagaagcagaagctggcaacacgcagtacctgaagtttgacggtactaaagcggttgcagaagttagcgctgagttagaaaaagcactagcataa

SEQ ID NO: 903 - protein, 214 aa, Photobacterium profundum
MRIILLGAPGAGKGTQAQFIMAKFGIPQISTGDMLRAAIKAGTELGKQAKSVIDAGQLVSDDIILGLVKERIAQDDCAKGFLLDGFPRTIPQADGLKEVGVVVDYVIEFDVADSVIVERMAGRRAHLASGRTYHNVYNPPKVEGKDDVTGEDLVIREDDKEETVLARLGVYHNQTAPLIAYYGKEAEAGNTQYLKFDGTKAVAEVSAELEKALA

SEQ ID NO: 904 - DNA, 645 bp, Salmonella typhi
  CDS (1)..(645): transl_table=11
atgcgtattattctgcttggcgctccgggcgcgggtaaaggaactcaggctcagttcatcatggagaaatatggtattccgcaaatctccactggcgatatgctgcgcgccgcagtgaaatcaggctccgagttgggcaaacaggcgaaagatatcatggacgccggtaaactggtgaccgatgaactggtgattgcgctggttaaagagcgtatcgcccaggaagactgccgtaacggttttctgctggacggtttcccgcgcacgatcccgcaggctgacgcgatgaaagaagcgggtattgtggtggattacgtgctggaattcgacgtaccggacgaactgatcgttgaccgtattgtgggtcgtcgcgtacacgccgcctctggccgcgtttaccacgttaagtttaatccgccgaaagtggaaggcaaagatgacgtcaccggcgaagatctgacgacccgtaaagacgatcaggaagagaccgttcgcaaacgtctggtggaatatcatcagatgaccgcgccgctgattggctactaccagaaagaagcggaagcgggcaacaccaaatacgctaaagttgacggtacgcaggccgttgccgacgtgcgcgcagcgctggaaaaaatcctcggttaa

SEQ ID NO: 905 - protein, 214 aa, Salmonella typhi
MRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGIVVDYVLEFDVPDELIVDRIVGRRVHAASGRVYHVKFNPPKVEGKDDVTGEDLTTRKDDQEETVRKRLVEYHQMTAPLIGYYQKEAEAGNTKYAKVDGTQAVADVRAALEKILG

SEQ ID NO: 906 - DNA, 645 bp, Shewanella oneidensis
  CDS (1)..(645): transl_table=11
atgcgcattatcctattgggcgccccaggtgccggtaaaggtacccaggcccagttcattatggaacagtatggtatcccacaaatttctactggcgatatgttacgtgcggccgttaaagccggtactccgctgggtttagaagcgaagaaagtgatggatgcaggccagctggtttctgatgatctgatcattggactggttaaagagcgtatcgcacaggacgattgtgctaaaggttttctgttagacggtttcccacgcactatcccacaagcggatgcgatggcggcaaacggtattagcattgatcacgtcatcgaaatcgatgtgccagacgaagaaatcgttaaacgcatgagcggtcgtcgcgttcaccccggttctggccgtgtttaccacgtagtattcaatccacctaaagtggaaggcaaggatgacgtgacgggcgaagatttagcgattcgtccagacgatgaagaagcgacagtacgtaagcgtttaggtatttaccatgagcaaactaagccattagttgagtactatggcaaagttgctgcggcgggtaacactcaataccacaaatttgatggtactcagtcagttgccgcggtgagcgagcagcttgccagcgtgcttaaataa

SEQ ID NO: 907 - protein, 214 aa, Shewanella oneidensis
MRIILLGAPGAGKGTQAQFIMEQYGIPQISTGDMLRAAVKAGTPLGLEAKKVMDAGQLVSDDLIIGLVKERIAQDDCAKGFLLDGFPRTIPQADAMAANGISIDHVIEIDVPDEEIVKRMSGRRVHPGSGRVYHVVFNPPKVEGKDDVTGEDLAIRPDDEEATVRKRLGIYHEQTKPLVEYYGKVAAAGNTQYHKFDGTQSVAAVSEQLASVLK

SEQ ID NO: 908 - DNA, 645 bp, Vibrio cholerae
  CDS (1)..(645): transl_table=11
atgcgcatcattcttctcggtgctccgggtgcaggtaaaggcacacaagctcaattcatcatggaaaaatttggtattccacaaatttctactggtgacatgctgcgtgcagccattaaggcgggcactgagctcggtaagcaagcgaaagcggtaatcgatgcaggacaattggtatcggatgacatcattttaggccttatcaaagagcgtattgctcaggctgactgtgagaaaggtttcctgctagatggtttccctcgcacgattccacaagccgatggcctaaaagagatgggtatcaatgttgactatgtgattgaatttgacgtagcggatgatgtgattgttgagcgtatggcgggtcgtcgtgctcatctaccttcaggccgtacgtaccacgtagtgtacaatccacctaaagttgaaggtaaagatgacgtaacgggtgaagaccttgtgatccgtgaagatgacaaagaagaaaccgtacgtgcgcgtctgaatgtttaccacacccaaactgcgccacttattgaatactacggtaaagaagcagctgcaggtaaaactcaatacctgaagtttgacggcactaagcaagtgagcgaagtgagtgctgacattgctaaagcgttggcttaa

SEQ ID NO: 909 - protein, 214 aa, Vibrio cholerae
MRIILLGAPGAGKGTQAQFIMEKFGIPQISTGDMLRAAIKAGTELGKQAKAVIDAGQLVSDDIILGLIKERIAQADCEKGFLLDGFPRTIPQADGLKEMGINVDYVIEFDVADDVIVERMAGRRAHLPSGRTYHVVYNPPKVEGKDDVTGEDLVIREDDKEETVRARLNVYHTQTAPLIEYYGKEAAAGKTQYLKFDGTKQVSEVSADIAKALA

SEQ ID NO: 910 - DNA, 645 bp, Vibrio parahaemolyticus
  CDS (1)..(645): transl_table=11
atgcgcatcattcttctaggtgctccaggtgcaggtaaaggcacacaagcaaacttcatcatggataaatacggtattccacaaatctctactggtgatatgcttcgtgctgctatcaaagcaggtacagaacttggcaaacaagctaaagctgttatcgacgctggtcagctagtttctgatgaaatcatccttggtcttatcaaagagcgtatcgctcaagacgattgtgagaaaggtttcctactagatggtttcccacgcactattcctcaggctgatggcctaaaagaaatgggcgttgaagtagattacgttatcgaattcgacgtagctgacgatgtgatcgttgagcgtatggctggtcgtcgtgctcaccttccttcaggtcgtacttaccacgttgtttacaacccacctaaagtggaaggtaaagacgacgtaacgggtgaagatcttgttgttcgcgatgacgacaaagaagaaacagtacgtgcacgtctaggtgtttaccacgagcaaactgcaccacttatcgattactacggtaaagaagctgcagcaggcaaaactaagtacctaaaatttgacggtactaagcaagttgctgaagtaagtgctgatatcgagaaggcattagcataa

SEQ ID NO: 911 - protein, 214 aa, Vibrio parahaemolyticus
MRIILLGAPGAGKGTQANFIMDKYGIPQISTGDMLRAAIKAGTELGKQAKAVIDAGQLVSDEIILGLIKERIAQDDCEKGFLLDGFPRTIPQADGLKEMGVEVDYVIEFDVADDVIVERMAGRRAHLPSGRTYHVVYNPPKVEGKDDVTGEDLVVRDDDKEETVRARLGVYHEQTAPLIDYYGKEAAAGKTKYLKFDGTKQVAEVSADIEKALA

SEQ ID NO: 912 - DNA, 645 bp, Vibrio vulnificus
  CDS (1)..(645): transl_table=11
atgcgcatcattcttctaggtgctccaggtgcaggtaaaggcacacaggctcaattcatcatggagaagtatggtattccacaaatctctactggtgacatgctacgtgctgctatcaaagcaggtactgagcttggtaaacaagcaaaagctgttatcgacgctggtcagctagtttctgatgaaatcattcttggtctaatcaaagagcgtattgctcaagaagattgtgcgaaaggtttcctattggatggtttcccacgtacgatcccacaagctgacggtcttaaagagatgggtgtggcagttgattacgttatcgagtttgacgttgctgacgatgtgatcgttgagcgtatggctggccgtcgtgcgcacctgccttcaggtcgtacttaccacgttgtttacaacccacctaaagtggaaggtaaagacgacgtaacaggtgaagatcttgttgttcgtgacgacgacaaagaagaaaccgtacgcgctcgtttaggtgtttaccactcacaaactgcaccacttatcgagtactacggtaaagaagccgcagaaggcaacacgaagtacctaaaatttgatggtactaagcaagttgctcaagtgagtgctgatatcgagaaggcattagcataa

SEQ ID NO: 913 - protein, 214 aa, Vibrio vulnificus
MRIILLGAPGAGKGTQAQFIMEKYGIPQISTGDMLRAAIKAGTELGKQAKAVIDAGQLVSDEIILGLIKERIAQEDCAKGFLLDGFPRTIPQADGLKEMGVAVDYVIEFDVADDVIVERMAGRRAHLPSGRTYHVVYNPPKVEGKDDVTGEDLVVRDDDKEETVRARLGVYHSQTAPLIEYYGKEAAEGNTKYLKFDGTKQVAQVSADIEKALA

SEQ ID NO: 914 - DNA, 645 bp, Vibrio vulnificus
  CDS (1)..(645): transl_table=11
atgcgcatcattcttctaggtgctccaggtgcaggtaaaggcacacaggctcaattcatcatggagaagtatggtattccacaaatctctactggtgacatgctacgtgctgctatcaaagcaggtactgagcttggtaaacaagcaaaagctgttatcgacgctggtcagctagtttctgatgaaatcattcttggtctaatcaaagagcgtattgctcaagaagattgtgcgaaaggtttcctattggatggtttcccacgtacgattccacaagctgacggtcttaaagagatgggtgtggcagttgattacgttatcgagtttgacgttgctgacgatgtgatcgttgagcgtatggctggccgtcgtgcgcacctgccttcaggtcgtacttaccacgttgtttacaacccacctaaagtggaaggtaaagacgacgtaacaggtgaagatcttgttgttcgtgacgacgacaaagaagaaaccgtacgcgctcgtttaggtgtttaccactcacaaacggcaccacttatcgagtactacggtaaagaagcggcagaaagcaacacgaagtacctaaaatttgatggtactaagcaagttgctcaagtgagtgctgatatcgagaaggcattagcataa

SEQ ID NO: 915 - protein, 214 aa, Vibrio vulnificus
MRIILLGAPGAGKGTQAQFIMEKYGIPQISTGDMLRAAIKAGTELGKQAKAVIDAGQLVSDEIILGLIKERIAQEDCAKGFLLDGFPRTIPQADGLKEMGVAVDYVIEFDVADDVIVERMAGRRAHLPSGRTYHVVYNPPKVEGKDDVTGEDLVVRDDDKEETVRARLGVYHSQTAPLIEYYGKEAAESNTKYLKFDGTKQVAQVSADIEKALA

SEQ ID NO: 916 - DNA, 645 bp, Yersinia enterocolitica
  CDS (1)..(645): transl_table=11
atgcgtatcattctgctgggcgctccgggcgctggtaagggtactcaggctcaattcatcatggagaaatacggtattccgcaaatgtgtactggtgatatgttgcgcgccgctgtaaaagcaggttctgagttaggtctgaaagcgaaagaaattatggatgccggcaagctggtcacgcatgaactggttatcgcattggttaaagagcgcattacacaggacgattgccgtgacggtttcctgctacatgggttcccgcgtaccattcctcaagctgatgccatgaaagaagccggtatcaaggttgattatgtattggagtttgatgttccagacgaactgattgttgatcgcatcgttgggcgtcgggtacatgctgcttcaggtcgggtttatcacattaaattcaacccacctaaagtggaagataaagatgatgtgaccggtgaagaactgacaattcgtaaagatgatcaggaagcaacagttcgcaaacgtctggttgaatatcatcagcaaactgcaccattggtttcttactatcgtaaagaagctgatgcaggtaacacacaatattttaaactggacggaacccgtaaagtagcagaagtcagtgcggaactggcgactattctcggttaa

SEQ ID NO: 917 - protein, 214 aa, Yersinia enterocolitica
MRIILLGAPGAGKGTQAQFIMEKYGIPQMCTGDMLRAAVKAGSELGLKAKEIMDAGKLVTHELVIALVKERITQDDCRDGFLLHGFPRTIPQADAMKEAGIKVDYVLEFDVPDELIVDRIVGRRVHAASGRVYHIKFNPPKVEDKDDVTGEELTIRKDDQEATVRKRLVEYHQQTAPLVSYYRKEADAGNTQYFKLDGTRKVAEVSAELATILG

SEQ ID NO: 918 - DNA, 645 bp, Yersinia pestis
  CDS (1)..(645): transl_table=11
atgcgtatcattctgctgggcgctccgggcgcaggtaaaggtactcaggctcaattcatcatggagaaatacggcattccgcaaatctctactggtgacatgttgcgcgccgctgtaaaagcaggttctgagttaggtctgaaagcaaaagaaattatggatgcgggcaagttggtgactgatgagttagttatcgcattagtcaaagaacgtatcacacaggaagattgccgcgatggttttctgttagacgggttcccgcgtaccattcctcaggcagatgccatgaaagaagccggtatcaaagttgattatgtgctggagtttgatgttccagacgagctgattgttgagcgcattgtcggccgtcgggtacatgctgcttcaggccgtgtttatcacgttaaattcaacccacctaaagttgaagataaagatgatgttaccggtgaagagctgactattcgtaaagatgatcaggaagcgactgtccgtaagcgtcttatcgaatatcatcaacaaactgcaccattggtttcttactatcataaagaagcggatgcaggtaatacgcaatattttaaactggacggaacccgtaatgtagcagaagtcagtgctgaactggcgactattctcggttaa

SEQ ID NO: 919 - protein, 214 aa, Yersinia pestis
MRIILLGAPGAGKGTQAQFIMEKYGIPQISTGDMLRAAVKAGSELGLKAKEIMDAGKLVTDELVIALVKERITQEDCRDGFLLDGFPRTIPQADAMKEAGIKVDYVLEFDVPDELIVERIVGRRVHAASGRVYHVKFNPPKVEDKDDVTGEELTIRKDDQEATVRKRLIEYHQQTAPLVSYYHKEADAGNTQYFKLDGTRNVAEVSAELATILG

SEQ ID NO: 920 - DNA, 888 bp, Arabidopsis thaliana
  CDS (1)..(888)
atggcggtttctcaccgtctcctcaggccggcgacgacgacgataaagaatactttttcttctctctttattaggtctctctcttcttcttcgtctgggtcctcgctagaccccaaaatcgatctggaggaggctgcggctcagctcgggaagtcttcgtctacgtcaacgtctccatacaaaggcagaaatttccactgggtgtttcttggatgtcctggtgttggtaaaggaacctatgcctctcgtctctcttctctcctcggcgttcctcatattgccactggtgatctcgttcgtgaagagctctcctcctctggcctcctctcctctcagctcaaggagcttgttaaccatggaaaactagttcctgatgaattcataataagtttgttatcaaagcgtctccaagctggcaaagacaagggtgaatctggatacattcttgatggttttccacgcaccgtgactcaagcggaaatactggagggagtaactaatatcgatctggtgattaacctgaagctacgagaagaggcattgcttgcgaaatgtttaggaagaagaatttgcagcgagtgtggtggaaactataacgttgcctgcattgatatcaaaggtgatgatgatactcccagaatgtatatgcctcctcttcttcctccgccaaactgtgaatcgaagcttataagccgagctgatgacactgaagaagttgtcaaggaaagactcaggatttacaacaaaatgactcaaccagtggaggaattctacaagaaacgcgggaagctgttggaatttgaattgcccggtggaatcccagagtcatgggcaaggctccttagggcattacaccttgaagacgataaacagtctgcaatagcctaa

SEQ ID NO: 921 - protein, 295 aa, Arabidopsis thaliana
MAVSHRLLRPATTTIKNTFSSLFIRSLSSSSSGSSLDPKIDLEEAAAQLGKSSSTSTSPYKGRNFHWVFLGCPGVGKGTYASRLSSLLGVPHIATGDLVREELSSSGLLSSQLKELVNHGKLVPDEFIISLLSKRLQAGKDKGESGYILDGFPRTVTQAEILEGVTNIDLVINLKLREEALLAKCLGRRICSECGGNYNVACIDIKGDDDTPRMYMPPLLPPPNCESKLISRADDTEEVVKERLRIYNKMTQPVEEFYKKRGKLLEFELPGGIPESWARLLRALHLEDDKQSAIA

SEQ ID NO: 922 - DNA, 627 bp, Arabidopsis thaliana
  CDS (1)..(627)
atgggatctgttgatgctgctaatggaagtgggaagaaacctacagttatatttgttcttggtggtccaggaagtggaaaaggtacccagtgtgcttatattgttgaacattatggttacacacatctgagtgctggagatcttcttagagctgagattaaatcaggttctgaaaatggaactatgatccagaatatgattaaagaggggaagattgtaccttctgaggttactatcaagcttctacagaaagctattcaggaaaacgggaatgacaagttcctcattgatggtttccctcgtaatgaggaaaaccgagcagcatttgaaaaagttactgagattgaaccaaagtttgtcttattcttcgattgtcctgaggaagagatggagaagcgcctgttgggccgaaaccaggggagagaggatgacaatattgagactataaggaagcgctttaaggtgtttcttgaatctagcttaccagtgattcattactacgaagctaaggggaaagttaggaagattaatgctgcaaagcccattgaagctgtcttcgaggaggtgaaggcaattttttctcctgaagctgagaaggtaaaactcaatagttgtgctattctctaa

SEQ ID NO: 923 - protein, 208 aa, Arabidopsis thaliana
MGSVDAANGSGKKPTVIFVLGGPGSGKGTQCAYIVEHYGYTHLSAGDLLRAEIKSGSENGTMIQNMIKEGKIVPSEVTIKLLQKAIQENGNDKFLIDGFPRNEENRAAFEKVTEIEPKFVLFFDCPEEEMEKRLLGRNQGREDDNIETIRKRFKVFLESSLPVIHYYEAKGKVRKINAAKPIEAVFEEVKAIFSPEAEKVKLNSCAIL

SEQ ID NO: 924 - DNA, 609 bp, Arabidopsis thaliana
  CDS (1)..(609)
atgggatctgttgatgctgctaatggaagtgggaagaaacctacagttatatttgttcttggtggtccaggaagtggaaaaggtacccagtgtgcttatattgttgaacattatggttacacacatctgagtgctggagatcttcttagagctgagattaaatcaggttctgaaaatggaactatgatccagaatatgattaaagaggggaagattgtaccttctgaggttactatcaagcttctacagaaagctattcaggaaaacgggaatgacaagttcctcattgatggtttccctcgtaatgaggaaaaccgagcagcatttgaaaaagttactgagattgaaccaaagtttgtcttattcttcgattgtcctgaggaagagatggagaagcgcctgttgggccgaaaccaggggagagaggatgacaatattgagactataaggaagcgctttaaggtgtttcttgaatctagcttaccagtgattcattactacgaagctaaggggaaagttaggaagattaatgctgcaaagcccattgaagctgtcttcgaggaggtgaaggcaattttttctcctgaagctgagaaggttgaagcctag

SEQ ID NO: 925 - protein, 202 aa, Arabidopsis thaliana [sequence omitted]

SEQ ID NO: 926 - DNA, 1767 bp, Arabidopsis thaliana
  CDS (1)..(1767)
atggcgtctctttctctcagttctgctcatttctcttcaacttcttcttcatctcgctcctctatatccacttcatcgctttctccgtcgtcaacttctctccctctcttacaatcaccgatccgccgccgttaccgctccctccgccgccgtctctccttctccgtcattccccgtcggacttctcgctccttctccacttccaattctcagattaggtgttcgataaatgagccgttgaaggtgatgatttcgggtgcaccggcttcaggaaaaggcactcaatgtgagctcattgttcacaagtttggtttggtgcacatatcaacaggggatctattgagagcagaggtgtcatctgggacagatattggaaagagagcaaaagagttcatgaactcgggtagtttggttcctgatgagattgttatagcgatggtggctggaagattatcacgtgaagatgctaaagagcatggatggcttcttgatggatttccacggagttttgcccaggcacaaagtctggacaaactgaacgtgaaacctgacatttttatcttactagatgttcctgatgaaattctgatcgatagatgtgttggtcgaaggttggatccagtgactggaaaaatttatcatatcaaaaattaccctcctgaatcagatgaaattaaagcaagactggttacacgcccggatgatacagaggagaaggtaaaagcacggctgcaaatatacaaacaaaattctgaagcgattatttcagcatactcagatgttatggtcaagattgatgcaaacaggccaaaagaagtggttttcgaggagacccagactctactgtctcagatacagttaaagagaatgataaagactgataaagcatctcctgttcaggataaatggagaggaataccgacgagattgaataacattccacattcgagggatatcagggcttatttttatgaagatgtgctgcaagccacaattagatctatcaaggatggtaacacccgtcttcgggtggacattaatatccctgagctaaatccggaaatggatgtttaccggataggaaccttgatggaacttgttcaagctttagctttatcattcgctgacgatggaaaaagagtgaaggtttgtgttcagggatcaatgggggaaggtgcacttgctgggatgccattgcagttggcaggcactcgaaagattttagaatatatggactggggtgatgatgaaactttgggaactttcgtcaagcttggtgcaattggtggtaaagaagttgatgaagaagatgacatgttcatcttagtggctccacaaaatgccgttggaaactgtattatagatgatctacaagcgatgactactgctgctgggaaaaggccagttgtacttatcaatcctcgcctcaaggacttgcccgcttcgagtggcataatgcaaacaatgggcagggagcaaaggctggaatatgctttgacgtttgacaactgctatgtattccggcttctctattatttgggaacacaatacccgattatgggcgctctaaggatgtcttatccataccggtatgagctttataagagagtgaacgaggaaaatggaaaggagaaatatgtcttgctagcaacgtacgctgaaagaccaacccctgaacaaatcgacgatgccttctctggaaaatcgcgggatcaaagcaagaaggcgtcaggaatctgggggttcttgagtagcgtgttttcgtaa

SEQ ID NO: 927 - protein, 588 aa, Arabidopsis thaliana
MASLSLSSAHFSSTSSSSRSSISTSSLSPSSTSLPLLQSPIRRRYRSLRRRLSFSVIPRRTSRSFSTSNSQIRCSINEPLKVMISGAPASGKGTQCELIVHKFGLVHISTGDLLRAEVSSGTDIGKRAKEFMNSGSLVPDEIVIAMVAGRLSREDAKEHGWLLDGFPRSFAQAQSLDKLNVKPDIFILLDVPDEILIDRCVGRRLDPVTGKIYHIKNYPPESDEIKARLVTRPDDTEEKVKARLQIYKQNSEAIISAYSDVMVKIDANRPKEVVFEETQTLLSQIQLKRMIKTDKASPVQDKWRGIPTRLNNIPHSRDIRAYFYEDVLQATIRSIKDGNTRLRVDINIPELNPEMDVYRIGTLMELVQALALSFADDGKRVKVCVQGSMGEGALAGMPLQLAGTRKILEYMDWGDDETLGTFVKLGAIGGKEVDEEDDMFILVAPQNAVGNCIIDDLQAMTTAAGKRPVVLINPRLKDLPASSGIMQTMGREQRLEYALTFDNCYVFRLLYYLGTQYPIMGALRMSYPYRYELYKRVNEENGKEKYVLLATYAERPTPEQIDDAFSGKSRDQSKKASGIWGFLSSVFS

SEQ ID NO: 928 - DNA, 852 bp, Arabidopsis thaliana
  CDS (1)..(852)
atgacgggctgtgtgaattctatttctccgccgccggtgactttataccggcatcgtgcctctccgtcacggtcgtccttctcattatccggcgatgccttacactctctttaccggcaccgacgtgtatcaagatctccgtcgattatcgctcccaaatttcagattgtggcggctgaaaaatcggagcctctgaaaattatgatatcaggagctcctgcttctggtaaaggtacacaatgcgagctgattactcacaaatatggtttggtgcatatctctgctggagatttgctgagggctgaaatcgcttctggaagtgaaaatggaagacgtgctaaagaacatatggagaaaggacaattggtccctgatgaaatagttgtaatgatggtaaaagatcgtttatcacagacagattcagagcaaaaaggatggcttttggatggatatccaaggagtgcatcacaggcaacagctctcaagggatttggattccagcctgatctattcattgtcctcgaagttcctgaagaaattctaattgaaagagttgttgggcgtcgattggatcctgtcacaggaaagatctaccacttgaagtattcgcctccagagacagaagagattgctgttagactcacccaacgttttgatgataccgaagagaaggcaaaactgcggctgaagactcataaccaaaatgtgagtgatgtgctttctatgtacgacgatataacaattaagatcgagggaaaccgctcaaaagaggaagtgtttgcccagatcgattcttctctgtccgaattgcttcaagagaggaacactgctccaagttcacttttaagttga

SEQ ID NO: 929 - protein, 283 aa, Arabidopsis thaliana
MTGCVNSISPPPVTLYRHRASPSRSSFSLSGDALHSLYRHRRVSRSPSIIAPKFQIVAAEKSEPLKIMISGAPASGKGTQCELITHKYGLVHISAGDLLRAEIASGSENGRRAKEHMEKGQLVPDEIVVMMVKDRLSQTDSEQKGWLLDGYPRSASQATALKGFGFQPDLFIVLEVPEEILIERVVGRRLDPVTGKIYHLKYSPPETEEIAVRLTQRFDDTEEKAKLRLKTHNQNVSDVLSMYDDITIKIEGNRSKEEVFAQIDSSLSELLQERNTAPSSLLS

SEQ ID NO: 930 - DNA, 747 bp, Arabidopsis thaliana
  CDS (1)..(747)
atggcaacgagcagtgcggcttctgttgatatggaagatattcagactgttgatctcatgtctgagcttcttcgccgtatgaaatgtgcctctaaacctgacaaacgtctcgttttcatcggtccacctggttcagggaaaggtacacagtctccggtcataaaggatgagttttgtttgtgtcatttgtctactggtgacatgcttagagctgctgttgctgctaagactcctcttggtgtgaaggcaaaggaagcaatggataagggagagcttgtttctgatgacttggttgttggtatcatggatgaagcaatgaacagacccaaatgtcagaaaggtttcattcttgatgggttcccgcggactgtgactcaagcagagaagcttgatgagatgcttaatagaaggggagctcagatagataaggtgcttaattttgcgatcgatgattcggttctcgaagaaagaattactggaaggtggattcacccttcaagtggaagaagctatcatactaaattcgcacctcctaaagttccaggagtcgatgatctgactggagagccattgattcaacgtaaagatgacaatgcggatgttcttagatcaaggctagatgcattccacaagcagacgcaaccggtaattgactattatgcgaagaaggagaatctggtgaacataccggcagagaaggccccggaagaggttacaaaagtggtgaagaaggttgtgtctacatga

SEQ ID NO: 931 - protein, 248 aa, Arabidopsis thaliana
MATSSAASVDMEDIQTVDLMSELLRRMKCASKPDKRLVFIGPPGSGKGTQSPVIKDEFCLCHLSTGDMLRAAVAAKTPLGVKAKEAMDKGELVSDDLVVGIMDEAMNRPKCQKGFILDGFPRTVTQAEKLDEMLNRRGAQIDKVLNFAIDDSVLEERITGRWIHPSSGRSYHTKFAPPKVPGVDDLTGEPLIQRKDDNADVLRSRLDAFHKQTQPVIDYYAKKENLVNIPAEKAPEEVTKVVKKVVST

SEQ ID NO: 932 - DNA, 741 bp, Arabidopsis thaliana
  CDS (1)..(741)
atggcgaccggtggtgctgcggcggatttggaagatgttcagacggtggatctcatgtcggagctcctccgccgcctcaagtgttctcagaagcccgacaaacgcctcatcttcattggacctccagggtcagggaaaggtactcaatctccagtagtgaaggatgagtattgcttgtgtcacttatccactggagacatgttaagagctgctgttgcttctaagacccctcttggtgtcaaggctaaagaagctatggaaaaaggagagctcgtctctgatgatttggttgttggtataattgatgaagccatgaacaagccaaaatgtcaaaaaggatttatccttgatgggttccccaggactgttactcaggcagagaagctcgatgagatgcttaagaggcgaggaactgaaattgacaaagttctcaactttgctattgatgacgcaatcttggaggaaagaataaccgggcgatggatccacccatcgagtggcaggagttaccacaccaaatttgctcctcccaaaacccctggagttgatgatattactggagagcctctgatccaacgtaaagatgataacgctgatgttctaaagtcgaggcttgcagctttccacagtcaaactcaaccggtgattgattactacgcaaagaaggccgttctcacaaacatccaggccgagaaggctccccaagaagttacatcagaggttaaaaaagcattgtcatga

SEQ ID NO: 933 - protein, 246 aa, Arabidopsis thaliana
MATGGAAADLEDVQTVDLMSELLRRLKCSQKPDKRLIFIGPPGSGKGTQSPVVKDEYCLCHLSTGDMLRAAVASKTPLGVKAKEAMEKGELVSDDLVVGIIDEAMNKPKCQKGFILDGFPRTVTQAEKLDEMLKRRGTEIDKVLNFAIDDAILEERITGRWIHPSSGRSYHTKFAPPKTPGVDDITGEPLIQRKDDNADVLKSRLAAFHSQTQPVIDYYAKKAVLTNIQAEKAPQEVTSEVKKALS

SEQ ID NO: 934 - DNA, 669 bp, Oryza sativa
  CDS (1)..(669)
atgggttcggttgtggatgctccaacagttgtggctggacaggaggaggtcactgacaacatgttgggtgacaagaaagttacagttgtatttgttctaggtggtcctgggagtggaaagggcacacagtgtgccaacattgttgaacactttggattcattcatcttagtgctggagaccttttgcgtgcagagatcaaatctggctctgagaacggaactatgatcgagaacatgataaaggagggaaagattgttccatctgaggtaactataaaactcttgcaggaagccatgattaaaagtggaaatgataagttccttattgatggatttccaaggaacgaagagaatcgtgctgcatttgagaacgttacaaaaataactcctgcgtttgtgctattcttcgattgttctgaggaagagatggaaagacgtcttttgggacgcaatcagggaagagttgacgataacattgagactatcaggaaaaggttcaaagtttttgttgaatccagtttgcctgtcattgagtactataatgcaaaggacaaggttaaaaagattgatgctgcaaaaccaattcctgaggtgtttgaagatgtcaaagccattttcgctccatatgcgccaaatgctttgctctcaggtgtgactacaaatctgtga

SEQ ID NO: 935 - protein, 222 aa, Oryza sativa
MGSVVDAPTVVAGQEEVTDNMLGDKKVTVVFVLGGPGSGKGTQCANIVEHFGFIHLSAGDLLRAEIKSGSENGTMIENMIKEGKIVPSEVTIKLLQEAMIKSGNDKFLIDGFPRNEENRAAFENVTKITPAFVLFFDCSEEEMERRLLGRNQGRVDDNIETIRKRFKVFVESSLPVIEYYNAKDKVKKIDAAKPIPEVFEDVKAIFAPYAPNALLSGVTTNL

SEQ ID NO: 936 - DNA, 645 bp, Oryza sativa
  CDS (1)..(645)
atgggttcggttgtggatgctccaacagttgtggctggacaggaggaggtcactgacaacatgttgggtgacaagaaagttacagttgtatttgttctaggtggtcctgggagtggaaagggcacacagtgtgccaacattgttgaacactttggattcattcatcttagtgctggagaccttttgcgtgcagagatcaaatctggctctgagaacggaactatgatcgagaacatgataaaggagggaaagattgttccatctgaggtaactataaaactcttgcaggaagccatgattaaaagtggaaatgataagttccttattgatggatttccaaggaacgaagagaatcgtgctgcatttgagaacgttacaaaaataactcctgcgtttgtgctattcttcgattgttctgaggaagagatggaaagacgtcttttgggacgcaatcagggaagagttgacgataacattgagactatcaggaaaaggttcaaagtttttgttgaatccagtttgcctgtcattgagtactataatgcaaaggacaaggttaaaaagattgatgctgcaaaaccaattcctgaggtgtttgaagatgtcaaagccattttcgctccatatgcgccaaatgccgcttag

SEQ ID NO: 937 - protein, 214 aa, Oryza sativa
MGSVVDAPTVVAGQEEVTDNMLGDKKVTVVFVLGGPGSGKGTQCANIVEHFGFIHLSAGDLLRAEIKSGSENGTMIENMIKEGKIVPSEVTIKLLQEAMIKSGNDKFLIDGFPRNEENRAAFENVTKITPAFVLFFDCSEEEMERRLLGRNQGRVDDNIETIRKRFKVFVESSLPVIEYYNAKDKVKKIDAAKPIPEVFEDVKAIFAPYAPNAA

SEQ ID NO: 938 - DNA, 882 bp, Oryza sativa
  CDS (1)..(882)
atggcggccgtgcagcgactcctgcgggcgtccgcctccggtggcgcggcggcggcggcggcggcggcgaggaggcgcatgtccacggcggtggcgccggagcagacgcctgcggccgcggcgttcccgttcgcggcggcggcggggagggcgaggcagcgggtggcggaggagaggaacgtgcagtgggtgttcctcgggtgccccggcgtgggcaaggggacttatgccagccgcctctcccgcctcctcggcgtgccccacatcgccaccggggatctcgtccgcgacgagctcgcttcctccggccccctatctgtgcagcttgctgaaattgttaatcaggggaaattagtttctgatgaaattatcatcaatctgttatctaaacgtcttaagaaaggagaagagcagggggaatcgggatttattctggatggttttccacgtactgtaaaacaagcggaaattcttgatggagttactgacattgatatggtggtcaatctaaagttgagagaggatgtcctagttgagaagtgccttggcagacgtatttgtggccaatgtggaaagaacttcaatttggcctgcattgatgtgaagggtgaaaatgggctgccaccaatctacatggcaccactattgcccccaaataactgtatgtcaaagcttatcaccagagctgatgataccgaagaggtcgtgagaaatcgtcttcagatatataatgacatgagccaacctgttgagggtttctaccggcaacaggggaagcttttagaatttgatttgcctggaggaatccctgagtcttggccaaagctgctccatgttctaaatctcgaggaccaagaagagatgaagctggccactgcgtaa

SEQ ID NO: 939 - protein, 293 aa, Oryza sativa
MAAVQRLLRASASGGAAAAAAAARRRMSTAVAPEQTPAAAAFPFAAAAGRARQRVAEERNVQWVFLGCPGVGKGTYASRLSRLLGVPHIATGDLVRDELASSGPLSVQLAEIVNQGKLVSDEIIINLLSKRLKKGEEQGESGFILDGFPRTVKQAEILDGVTDIDMVVNLKLREDVLVEKCLGRRICGQCGKNFNLACIDVKGENGLPPIYMAPLLPPNNCMSKLITRADDTEEVVRNRLQIYNDMSQPVEGFYRQQGKLLEFDLPGGIPESWPKLLHVLNLEDQEEMKLATA

SEQ ID NO: 940 - DNA, 858 bp, Oryza sativa
  CDS (1)..(858)
atggcggcgatctcgcgcgcgatccgggcgtgcgccgccgcggggtcccggcggagcatggcgtcgtcggcgaaggaggtggcggcggccggggcgcgggcggcggcggcggtggcgcggcgcgggcgggagcgggagcgggaggaggacgggaggcgcgtgcagtgggtgttcctgggctgccccggggtggggaagggcacctacgccagccgcctctcgcagatgctccgcgtgccccacatcgccaccggcgatctcgtccgcgacgccctcgcctccccgggccccttctccgagcagcttgcggagattgtgaataatggaaagctagtgtcggatgagatcataataaatcttctgtcaaagcggcttgaagagggagcagaaaagggtgagctgggcttcatccttgatggttttccaagaaccataagacaagcggagatacttgaaggagtcacggatattgatttggtcatcaacctcaaactccgagaagaggctctgcttgcaaaatgccttggtagaaggatgtgcagccagtgtggtggaaattttaatgtagcgtccattgatatggagggcgaaaatggtggtcctcgaatgtacatgcctccactactgcctcctccacagtgtgaatcaaagttgataactaggcctgatgatactgaagaggtggtaaaggagcgattgcgtgtttatcatgatttgtgtgagccagtggaggacttctacagagcacgtggtaaactattggagttcaatctaccaggaggaattccagaatcatggccgaagttactgcaagcattgaatttagaccctggcaatgaaagatctgcagcagcatga

SEQ ID NO: 941 - protein, 285 aa, Oryza sativa
MAAISRAIRACAAAGSRRSMASSAKEVAAAGARAAAAVARRGREREREEDGRRVQWVFLGCPGVGKGTYASRLSQMLRVPHIATGDLVRDALASPGPFSEQLAEIVNNGKLVSDEIIINLLSKRLEEGAEKGELGFILDGFPRTIRQAEILEGVTDIDLVINLKLREEALLAKCLGRRMCSQCGGNFNVASIDMEGENGGPRMYMPPLLPPPQCESKLITRPDDTEEVVKERLRVYHDLCEPVEDFYRARGKLLEFNLPGGIPESWPKLLQALNLDPGNERSAAA

SEQ ID NO: 942 - DNA, 774 bp, Oryza sativa
  CDS (1)..(774)
atggcggcgatctcgcgcgcgatccgggcgtgcgccgccgcggggtcccggcggagcatggcgtcgtcggcgaaggaggtggcggcggccggggcgcgggcggcggcggcggtggcgcggcgcgggcgggagcgggagcgggaggaggacgggaggcgcgtgcagtgggtgttcctgggctgccccggggtggggaagggcacctacgccagccgcctctcgcagatgctccgcgtgccccacatcgccaccggcgatctcgtccgcgacgccctcgcctccccgggccccttctccgagcagcttgcggagattgtgaataatggaaagctagtgtcggatgagatcataataaatcttctgtcaaagcggcttgaagagggagcagaaaagggtgagctgggcttcatccttgatggttttccaagaaccataagacaagcggagatacttgaaggagtcacggatattgatttggtcatcaacctcaaactccgagaagaggctctgcttgcaaaatgccttggtagaaggatgtgcagccagtgtggtggaaattttaatgtagcgtccattgatatggagggcgaaaatggtggtcctcgaatgtacatgcctccactactgcctcctccacagtgtgaatcaaagttgataactaggcctgatgatactgaagaggtggtaaaggagcgattgcgtgtttatcatgatttggtatgttctagcttgtgttatttttatttattgaattcctcacttgtaatttgctag

SEQ ID NO: 943 - protein, 257 aa, Oryza sativa
MAAISRAIRACAAAGSRRSMASSAKEVAAAGARAAAAVARRGREREREEDGRRVQWVFLGCPGVGKGTYASRLSQMLRVPHIATGDLVRDALASPGPFSEQLAEIVNNGKLVSDEIIINLLSKRLEEGAEKGELGFILDGFPRTIRQAEILEGVTDIDLVINLKLREEALLAKCLGRRMCSQCGGNFNVASIDMEGENGGPRMYMPPLLPPPQCESKLITRPDDTEEVVKERLRVYHDLVCSSLCYFYLLNSSLVIC

SEQ ID NO: 944 - DNA, 732 bp, Oryza sativa
  CDS (1)..(732)
atggcacacgcaaacaagaatcacattgagtcatttccacctcctgggaaaaagataacaatcgtgttcgtcataggtggccctggcagtggcaaaggcactcaatgtgccaaaattgttaagcagtttggctttacacatctgagtgctggtgatctccttcgtgaagaagcaaaatatgatactgaacaaggtacaatgatcaagaatctcatgaatgaagggaagcttgtgtcatctgatctcatcgttaagctactatttaaggccatgcgagaaagtgggaatgataagttccttgttgatggatttccacgaaatgaagaaaatcgacatgcgtatgaaaatattatccacattgagccagagttcctgctgttcattgactgctcaaaggaagagatggagcggcgcattttgaaccgaaaccagggaagagatgatgacaacatcgacactattaggagacgctttgatgtttttcagcagcaaactcttccagttattcagtactatgagaaaagggggaaactcagaaaggttgatggtaaccgacaggtagatgaagttttcgaagacgttaaggccatttttgctcagttgaacaatcagaaaattcatggtggccagcaagctagtggtttgagcagagcacaaatgaatccattgaaacgttggttctttgactttttctgcggttgctttgggactaaagaagaagcaagaaactga

SEQ ID NO: 945 - protein, 243 aa, Oryza sativa
MAHANKNHIESFPPPGKKITIVFVIGGPGSGKGTQCAKIVKQFGFTHLSAGDLLREEAKYDTEQGTMIKNLMNEGKLVSSDLIVKLLFKAMRESGNDKFLVDGFPRNEENRHAYENIIHIEPEFLLFIDCSKEEMERRILNRNQGRDDDNIDTIRRRFDVFQQQTLPVIQYYEKRGKLRKVDGNRQVDEVFEDVKAIFAQLNNQKIHGGQQASGLSRAQMNPLKRWFFDFFCGCFGTKEEARN

SEQ ID NO: 946 - DNA, 636 bp, Oryza sativa
  CDS (1)..(636)
atgggttcagttgtggatgctccagtggttgtggagggggttgctgagaacatgttgggtgataagaaagttacagttgtatttgttctaggtggtcctggaagtggaaaaggcacacagtgtgccaacattgtggaacactttggattcacccacttaagtgctggagaccttttgcgtgcagagataaaatctggttctgagaatggaactatgattgagaacatgataaaggaggggaagattgttccgtcagaggttactataaagctcttgcaagatgccatgattaaaaatgagaatgataagtttctaatcgatgggttcccaaggaatgaagagaatcgtgctgccttcgagaatgttacaaaaatttcccctgcatttgtgctattttttgactgttctgaagaagagatggaaagacgtcttttgggacgcaatcagggtagagttgatgacaacattgagaccattaggaaaagattcaaagtttttgttgaatcaagtttgcctgtaattgagcactacaatgcgaagaacaaagttaaaaagattgatgctgcaaaaccaatttctgaagtgtttgaagatgtcaaagccatttttgccccatatgctaaggtaatctactga

SEQ ID NO: 947 - protein, 211 aa, Oryza sativa
MGSVVDAPVVVEGVAENMLGDKKVTVVFVLGGPGSGKGTQCANIVEHFGFTHLSAGDLLRAEIKSGSENGTMIENMIKEGKIVPSEVTIKLLQDAMIKNENDKFLIDGFPRNEENRAAFENVTKISPAFVLFFDCSEEEMERRLLGRNQGRVDDNIETIRKRFKVFVESSLPVIEHYNAKNKVKKIDAAKPISEVFEDVKAIFAPYAKVIY

SEQ ID NO: 948 - DNA, 633 bp, Oryza sativa
  CDS (1)..(633)
atgggttcagttgtggatgctccagtggttgtggagggggttgctgagaacatgttgggtgataagaaagttacagttgtatttgttctaggtggtcctggaagtggaaaaggcacacagtgtgccaacattgtggaacactttggattcacccacttaagtgctggagaccttttgcgtgcagagataaaatctggttctgagaatggaactatgattgagaacatgataaaggaggggaagattgttccgtcagaggttactataaagctcttgcaagatgccatgattaaaaatgagaatgataagtttctaatcgatgggttcccaaggaatgaagagaatcgtgctgccttcgagaatgttacaaaaatttcccctgcatttgtgctattttttgactgttctgaagaagagatggaaagacgtcttttgggacgcaatcagggtagagttgatgacaacattgagaccattaggaaaagattcaaagtttttgttgaatcaagtttgcctgtaattgagcactacaatgcgaagaacaaagttaaaaagattgatgctgcaaaaccaatttctgaagtgtttgaagatgtcaaagccatttttgccccatatgctaaggttgaatag

SEQ ID NO: 949 - protein, 210 aa, Oryza sativa
MGSVVDAPVVVEGVAENMLGDKKVTVVFVLGGPGSGKGTQCANIVEHFGFTHLSAGDLLRAEIKSGSENGTMIENMIKEGKIVPSEVTIKLLQDAMIKNENDKFLIDGFPRNEENRAAFENVTKISPAFVLFFDCSEEEMERRLLGRNQGRVDDNIETIRKRFKVFVESSLPVIEHYNAKNKVKKIDAAKPISEVFEDVKAIFAPYAKVE

SEQ ID NO: 950 - DNA, 873 bp, Oryza sativa
  CDS (1)..(873)
atggcctcttccatggccgccaccgccaccctctcgccgccggttttatccgccgagaggccgactgtccgcggcggcctcttcttgcccccttcgccggcgacctcccgctctctccgcctccaatccgcccgccgctgcggcatctcgccggcgaccaggaagccacgctccttgcctcgagcagccaaggttgttgtggctgtgaaggctgatcctttgaaggtcatgatagcaggggctccagcatctggaaagggaacgcagtgtgagctcatcaagagcaaatatggtctggtgcacatttctgctggagatttgctaagggcagaaattgctgcaggcagtgagaatgggaagcgagctaaggaatttatggagaagggtcagctggttcctgatgagattgttgttaatatggtgaaggaacgccttctgcaaccagatgctcaggaaaagggttggttgttggatgggtacccaagaagctattcgcaagcgatggcgctggaaactcttaatatccgacctgacattttcattcttttggatgttccagatgaacttcttgttgaaagggtagttgggagacggcttgatcctgtaactgggaaaatataccatctaaagtattccccaccggagaatgaagaaatcgcttcaaggcttacacagagatttgatgatacagaagaaaaggttaagctgaggttacagactcattatcaaaatgtagaatccttgctatcaatttacgaagatgtgatagttgaggtaaaaggggatgctttggtggatgatgtgtttgctgagatcgacaagcagctgacttctagccttgataagaaaacagaaatggtggctagcgcatga

SEQ ID NO: 951 - protein, 290 aa, Oryza sativa
MASSMAATATLSPPVLSAERPTVRGGLFLPPSPATSRSLRLQSARRCGISPATRKPRSLPRAAKVVVAVKADPLKVMIAGAPASGKGTQCELIKSKYGLVHISAGDLLRAEIAAGSENGKRAKEFMEKGQLVPDEIVVNMVKERLLQPDAQEKGWLLDGYPRSYSQAMALETLNIRPDIFILLDVPDELLVERVVGRRLDPVTGKIYHLKYSPPENEEIASRLTQRFDDTEEKVKLRLQTHYQNVESLLSIYEDVIVEVKGDALVDDVFAEIDKQLTSSLDKKTEMVASA

SEQ ID NO: 952 - DNA, 1620 bp, Oryza sativa
  CDS (1)..(1620)
atgggtcttcgttgccgggcatcggagggagcggcggcggcggcgcggaaggaggccccgctcaaggtgatgatctcgggtgcacccgcgtctgggaagggaacgcaatgccgcatgatcgtcgagaagtatggtttggttcacatatcaactggggatcttctgcgggccgaagtatcttctggcaccgaaataggcaagaaagcaaaagaatatatggacaatggtatgctagtcccggatcaagttgtgacagatatggtggtatcacgactatcacaacctgatgttagagaaagaggatggcttctcgatggttacccgagaagttatgcccaggcacaaagtctcgaaagtatgaaaatacgaccagatatattcattgtgctggaagttcctgatgatattctaatcgacagatgtgttggaagaaggttggatcctgagactggcaaaatttaccacataaagaacttccctccggagaatgatgaagtttctgctcgtcttgttacacgctctgatgatacatttgagaaggttaaatcacgtcttgatacttacaaacaaaattctgaagctgttatcccaacatactcagatttgctcaaccagattgatggaaatcgacaagtggaagtcgtttttaatgaaatagattcactgttacagaagatctgtgagaatgcttcatttaacatgttggccaaaacaaatggaaaaccacaagattctaaggatacaacagcctcaaaaaatgagtttcgtgggattccaacaagattaaataacattccacattccagggaaatcaggaaatacttttacaatgatgtactagtagccaccagacatgctgttgaagacaaaaaaactcggttgcagatagatatcaacattcctgaacttaaccctgaaatggatgtttatcgcataggaaccctcatggaacttgtgcgagagctttctctttcctttgctgatgatggaaagcgtgtgaaggtttgcgttcaaggctccatgggacaaggtgcatttgctggtattccacttcagcttgctggaaccagaaaaattttggaaatcatggactggggtgaatatggggccaagggtaccttcattaattttggagcagtaggtgctagtgaggttgataaagaagatgacatgttcatcctcattgctccccaaaatgctgttggaaactgtataattgatgacatgaaagcaatgactgatgctgctggtgacagacctgtgattcttgtaaatcctcgcttaaaggatatgcctggatcaagtggtgtaatgcaaacaatgggaagagacatgaggctaaaatatgctgcatcttttgagacttgttattccttccggcttctcttctatgctggctcattttatcctattatgggagctctaaggatggcttatcctaataaatatgagatttatcgaagggttgatgaacccaatggacaagaacgatatgttctcttagaggaatttgtggagaagccaactcctgatgaaatcaccaatgcattcagaccacgtaaaaacgaaaatgaaaagtcagcgtctggattctggggttttttgagtggtatattatga

SEQ ID NO: 953 - protein, 539 aa, Oryza sativa
MGLRCRASEGAAAAARKEAPLKVMISGAPASGKGTQCRMIVEKYGLVHISTGDLLRAEVSSGTEIGKKAKEYMDNGMLVPDQVVTDMVVSRLSQPDVRERGWLLDGYPRSYAQAQSLESMKIRPDIFIVLEVPDDILIDRCVGRRLDPETGKIYHIKNFPPENDEVSARLVTRSDDTFEKVKSRLDTYKQNSEAVIPTYSDLLNQIDGNRQVEVVFNEIDSLLQKICENASFNMLAKTNGKPQDSKDTTASKNEFRGIPTRLNNIPHSREIRKYFYNDVLVATRHAVEDKKTRLQIDINIPELNPEMDVYRIGTLMELVRELSLSFADDGKRVKVCVQGSMGQGAFAGIPLQLAGTRKILEIMDWGEYGAKGTFINFGAVGASEVDKEDDMFILIAPQNAVGNCIIDDMKAMTDAAGDRPVILVNPRLKDMPGSSGVMQTMGRDMRLKYAASFETCYSFRLLFYAGSFYPIMGALRMAYPNKYEIYRRVDEPNGQERYVLLEEFVEKPTPDEITNAFRPRKNENEKSASGFWGFLSGIL

SEQ ID NO: 954 - DNA, 732 bp, Oryza sativa
  CDS (1)..(732)
atggcggcggcggcgaacctggaggacgtcccgtccatggatctgatgaacgagctgctacgccgcatgaagtgcagctccaagcccgacaagcgcctcatcctcgtaggtccacctggctctggaaagggaacacaatcgcccattattaaggatgagtactgcttatgccatttagctacaggtgatatgttgagagctgctgttgctgctaagactcctttaggagtcaaggcgaaagaagcaatggacaagggagagcttgtttctgatgacttggttgttggaattattgatgaagccatgaagaaaccttcatgtcaaaagggtttcattcttgatgggttcccacggacagttgttcaggcacagaagcttgatgaaatgctggaaaagaaaggtacaaaggtcgataaggttcttaactttgccattgatgattcaattttggaagaaagaattactggccggtggatccatccctccagtggcaggagttatcacactaagtttgcacctccaaaggttcctggagttgatgatgtcactggagaaccactaattcaaaggaaagacgacacagctgaggttttgaagtctagacttgaagccttccacaaacaaactgaaccagtgattgactactactccaagaaggccttggtggccaatcttcatgccgagaagccaccgaaagaagtaactgctgaagtccagaaagttctttcgtaa

SEQ ID NO: 955 - protein, 243 aa, Oryza sativa
MAAAANLEDVPSMDLMNELLRRMKCSSKPDKRLILVGPPGSGKGTQSPIIKDEYCLCHLATGDMLRAAVAAKTPLGVKAKEAMDKGELVSDDLVVGIIDEAMKKPSCQKGFILDGFPRTVVQAQKLDEMLEKKGTKVDKVLNFAIDDSILEERITGRWIHPSSGRSYHTKFAPPKVPGVDDVTGEPLIQRKDDTAEVLKSRLEAFHKQTEPVIDYYSKKALVANLHAEKPPKEVTAEVQKVLS

SEQ ID NO: 956 - DNA, 726 bp, Oryza sativa
  CDS (1)..(726)
atggcggcgaacctggaggacgtgccgtcgatggagctgatgacggagctgctccgccgcatgaagtgcagctccaagcccgacaagcgcgtcatcctcgtcggtccacctggctgcggaaagggaacacagtcaccgctgattaaggatgaattttgcttgtgccatttagccactggtgatatgttgagggctgcagtggctgctaaaactccacttgggattaaggctaaagaagctatggacaagggagagcttgtttctgatgacttggttgttgggattattgatgaagccatgaagaaaacttcatgccagaaaggttttatccttgatggtttccctagaactgttgttcaagcacagaagcttgatgaaatgttggccaaacaaggtactaagattgacaaggttctaaattttgcaattgatgatgcaatactggaagaacgaattaccggtcgttggatccacccatcaagtggtagatcttatcatacaaaatttgctcctcctaagactcctggacttgatgatgttactggagaacccttaattcaaaggaaagatgacacagctgcagtattgaagtcaaggcttgaagccttccacgtacaaactaagcctgtgattgactactacaccaagaagggcatagtcgcaaatctgcatgccgaaaaaccaccaaaggaagtgactgttgaggtccagaaagccctatcataa

SEQ ID NO: 957 - protein, 241 aa, Oryza sativa
MAANLEDVPSMELMTELLRRMKCSSKPDKRVILVGPPGCGKGTQSPLIKDEFCLCHLATGDMLRAAVAAKTPLGIKAKEAMDKGELVSDDLVVGIIDEAMKKTSCQKGFILDGFPRTVVQAQKLDEMLAKQGTKIDKVLNFAIDDAILEERITGRWIHPSSGRSYHTKFAPPKTPGLDDVTGEPLIQRKDDTAAVLKSRLEAFHVQTKPVIDYYTKKGIVANLHAEKPPKEVTVEVQKALS

SEQ ID NO: 958 - DNA, 732 bp, Oryza sativa
  CDS (1)..(732)
atgtggcggcggcaagtgggtgcccttcttctccggcaccgatccacgccttcctccaccctccgccaccatctccccctccccgtccccgaccagagcccacctctcgcttccaatcttctgctccgcctcttcacttctcaatctggagaggggggtgatggtgccaccaagcccttcattgctttcgtcttagggggtcccgggagtgggaaaggtacgcaatgtgtccggatcgcttctgattttgggtttgctcatttgagtgctggtgaccttctacggagtgaaatttcaactggcagtgagaaaggggagttgatcttaaatataataaaagaagggaagattgttccatcagagattactgttgaactgattagaaaagctatggaatcgagcgatgctaaaagggttcttattgatggtttcccaaggtgtgaggaaaacaggatcgcctttgaaagaataactggaacagaaccagaccttgtgattttctttgactgccctgaggatgagatggttaaacgtttactaggccgtaaccagggacgagtggatgataacattgaaacaatcaagaagcgcctaaaggtgtttgagagtctaaatattcctgttgttgactactacacttcaagaggaaaggttcacaagataaatgcaaccggaactgaagaagaaatctttggagcagtccacaagctgttttcctccttaaggttttga

SEQ ID NO: 959 - protein, 243 aa, Oryza sativa
MWRRQVGALLLRHRSTPSSTLRHHLPLPVPDQSPPLASNLLLRLFTSQSGEGGDGATKPFIAFVLGGPGSGKGTQCVRIASDFGFAHLSAGDLLRSEISTGSEKGELILNIIKEGKIVPSEITVELIRKAMESSDAKRVLIDGFPRCEENRIAFERITGTEPDLVIFFDCPEDEMVKRLLGRNQGRVDDNIETIKKRLKVFESLNIPVVDYYTSRGKVHKINATGTEEEIFGAVHKLFSSLRF

SEQ ID NO: 960 - DNA, 909 bp, Brassica napus
  CDS (1)..(909)
atggcggttgttcaccgtctcttcaggctgttctcgccgtttacgccggcaaagaataatctttcttctttcttgatcaggtctctgtcttcttcttctccccatgggccatcgctggaccctgagatcgatctcaaagaagctgcggcggagctggaaaagtcctcctctccttcttcttctccgtctccgtccaaaggaagaaactttcactgggtgtttcttggatgtcccggtgttggtaaaggcacctacgcctctcgtctctccaccctcctcggcgttcctcatatcgctaccggtgatctcgtacgcgaagagctttcctcctctggtctcctctcctctcagctaaaggagcttgttaaccatggcaaattggttcctgatgaattcattataagcttgttatcaaagcgtcttgaagctggcaaggagaagggcgaatctggatacattcttgatgggtttccaagaaccgtgacacaagcagaaatactggagggagtaattaatgttgatctggtgatcaacctgaagctaaaggaagaggcgttactagcgaaatgtttagggagaaggatatgcagcgagtgtggtgcaaactataacgttgcatgcattgatatcaaaggtggtgatggtgatggtgatgatagaatgtatatgcctccgcttcttcctccacctaagtgtgaatcaaagcttattacccgagctgatgacactgaagaagttgtcaaggaaagactccgggtttacaacaaaatgactcaaccagtggaggagttctacaggaagcgtgggaagctgttggagtttgaattaccaggtggaatcccacagtcatggccgaaactacttagagcgttacaccttgaggatgataaacagtctgcaatagcctag

SEQ ID NO: 961 - protein, 302 aa, Brassica napus
MAVVHRLFRLFSPFTPAKNNLSSFLIRSLSSSSPHGPSLDPEIDLKEAAAELEKSSSPSSSPSPSKGRNFHWVFLGCPGVGKGTYASRLSTLLGVPHIATGDLVREELSSSGLLSSQLKELVNHGKLVPDEFIISLLSKRLEAGKEKGESGYILDGFPRTVTQAEILEGVINVDLVINLKLKEEALLAKCLGRRICSECGANYNVACIDIKGGDGDGDDRMYMPPLLPPPKCESKLITRADDTEEVVKERLRVYNKMTQPVEEFYRKRGKLLEFELPGGIPQSWPKLLRALHLEDDKQSAIA

SEQ ID NO: 962 - DNA, 630 bp, Brassica napus
  CDS (1)..(630)
atgggatctgttgttgatgctgcaaacaaggaggtaaatggaacctcaagtgcaaagaaaccaactgttatttttgtcctgggtggtccaggcagtgggaaaggtacacagtgtgcctatatcgttgagcattttggttacacacatctcagtgctggagaccttctcagggctgagattaaatcaggttctgaaaacggaacaatgatccagaacatgattaaagaagggaagattgtgccttctgaggtgacaatcaagcttctccagaaagcaattcaggagaacgggaatgacaagttcctcattgatggtttccctcggaatgaggagaaccgagcagcatttgaaaaagttactgagattgaaccaaagtttgtcttgttctttgattgtcctgaggaagagatggagagacgcttattaggacgtaaccaggggagagaggatgacaatattgagactataaggaagcgtttcaaggtgtttcttgagtctagcttaccagtgattcagtactatgaagctaaggggaaagttaggaagattcatgccgcaaagcccattgatgatgtatttcaggaggtgaaggcagtgttttctcctgaagctgagaaggttgcagcttag

SEQ ID NO: 963 - protein, 209 aa, Brassica napus
MGSVVDAANKEVNGTSSAKKPTVIFVLGGPGSGKGTQCAYIVEHFGYTHLSAGDLLRAEIKSGSENGTMIQNMIKEGKIVPSEVTIKLLQKAIQENGNDKFLIDGFPRNEENRAAFEKVTEIEPKFVLFFDCPEEEMERRLLGRNQGREDDNIETIRKRFKVFLESSLPVIQYYEAKGKVRKIHAAKPIDDVFQEVKAVFSPEAEKVAA

SEQ ID NO: 964 - DNA, 723 bp, Brassica napus
  CDS (1)..(723)
atggcggatttggaagatgttcagaccgtggatctcatgtccgagctcctccgccgtctcaaatgttcacaaaagcccgacaaacgcctcatcttcataggacctccagggtcagggaaaggtacacagtctccaatagtgaaggatgagttttgcttgtgtcatttatccactggggacatgttaagagctgctgttgcttccaagacccctcttggtctcaaggccaaagaagctatggacaagggagcgcttgttactgatgaactggttgttggtataattgatgaagccatgaacaagccaaaatgtcagaaaggttttatccttgatgggtttcccaggactgttgctcaggcagagaagctagacgagatgcttaagaagcgaggaactggaatcgacaaagttctcaactttgctattgatgactcagtcctggaggaaagaataaccggtagatggatccacccgtcgagtggcaggagttaccacaccaaattcgcgcctcccaaaactcctggcgttgatgatattaccggagagcctctgatccaacgcaaagatgataacgctgaggttctaaggtcaagacttgctgctttccacactcaaactgaaccggtgattgactactacgcgaagaaggctgttcttacaaacatccatgctgagaaggctccacaagaagttacgtcagaggttcagaaagcattgtcctga

SEQ ID NO: 965 - protein, 240 aa, Brassica napus
MADLEDVQTVDLMSELLRRLKCSQKPDKRLIFIGPPGSGKGTQSPIVKDEFCLCHLSTGDMLRAAVASKTPLGLKAKEAMDKGALVTDELVVGIIDEAMNKPKCQKGFILDGFPRTVAQAEKLDEMLKKRGTGIDKVLNFAIDDSVLEERITGRWIHPSSGRSYHTKFAPPKTPGVDDITGEPLIQRKDDNAEVLRSRLAAFHTQTEPVIDYYAKKAVLTNIHAEKAPQEVTSEVQKALS

SEQ ID NO: 966 - DNA, 630 bp, Brassica napus
  CDS (1)..(630)
atgggatccattgctgatgctgcaaacaaggaggttaatggaaccgcaagtgagaagagacccgctgttatttttgtccttggtggtccaggaagtgggaaaggtacacagtgtgcctatattgttgaccattttggttacacacatctgagtgctggagaccttctcagggctgaaattaaatcaggttctgaaaatgggactatgatccagaatatgattaaagaagggaagattgtaccttctgaggttacaatcaagcttcttcagaaagcaattcaggagaacgggaacgacaagttcctcattgatggcttccctcgcaatgaggagaaccgaacagcctttgaaaaagttactgggattgaacctaagtttgtcttgttctttgattgtcctgaggaagagatggagaggcgcctcttgggaagaaaccaggggagagaggatgacaatatagagactataaggaagcgtttcaaggtgtttcttgaatctagcttgccagtgattcagtactacgaagctaagggcaaagttcgcaagattcatgccgcaaagcctattgaagatgtgtttcaggaggtgaaggcagtcttttctcctgaagctgagaaggttgaagcctag

SEQ ID NO: 967 - protein, 209 aa, Brassica napus
MGSIADAANKEVNGTASEKRPAVIFVLGGPGSGKGTQCAYIVDHFGYTHLSAGDLLRAEIKSGSENGTMIQNMIKEGKIVPSEVTIKLLQKAIQENGNDKFLIDGFPRNEENRTAFEKVTGIEPKFVLFFDCPEEEMERRLLGRNQGREDDNIETIRKRFKVFLESSLPVIQYYEAKGKVRKIHAAKPIEDVFQEVKAVFSPEAEKVEA

SEQ ID NO: 968 - DNA, 846 bp, Brassica napus
  CDS (1)..(846)
atggcgagagtactgcgtgtggcgagatcctcctcctccctcttcagcttcggaagcagatcttattcagccgaagctagccacgtgtcctctccccctcctccgtttcttggagctcgcagagacgttaccaaggagagaaacgtgcagtgggtgttccccggttgtcccggtgtcgggaaggggacttacgccagcagactctcgagtctcctcggtgttcctcacatcgccaccggagatctcgtccgtgatgcgctagcttcttccggacctctctcccgacagctatcagagattgtaaaccaggggaagcttgtttctgatgagatcatagtgaacttattatcaaagagacttgaagctggtgaagccaagggcgaatcaggtttcattcttgatggctttcctcgtaccatgagacaagctgaaatattaggagatgtcactgacatcgatctagtggtgaacttaaagctacctgaggaggttttggttgacaaatgcttagggaggagaacgtgtaatcaatgcggtaaaggtttcaatatagctcacatcaacttaaagggtgagaatgggaaaccaggaatcagcatggatccacttctccctccacctcagtgtatgtcaaagctcatcactcgtgctgatgatactgaggaggttgtgaaagctaggctccgtatttacaatgaaaccagccagcctcttgaagagtactaccgtatcaagggaaagctgatggagtttgacttacctggaggcatccctgagtcttggccaaggctgttagaagctttaaggcttgatgattacgaggagaagcaatctgccgcggcgtag

SEQ ID NO: 969 - protein, 281 aa, Brassica napus
MARVLRVARSSSSLFSFGSRSYSAEASHVSSPPPPFLGARRDVTKERNVQWVFPGCPGVGKGTYASRLSSLLGVPHIATGDLVRDALASSGPLSRQLSEIVNQGKLVSDEIIVNLLSKRLEAGEAKGESGFILDGFPRTMRQAEILGDVTDIDLVVNLKLPEEVLVDKCLGRRTCNQCGKGFNIAHINLKGENGKPGISMDPLLPPPQCMSKLITRADDTEEVVKARLRIYNETSQPLEEYYRIKGKLMEFDLPGGIPESWPRLLEALRLDDYEEKQSAAA

SEQ ID NO: 970 - DNA, 624 bp, Glycine max
  CDS (1)..(624)
atgggaactgttgaagctgcaaacaaggatgcaaatggaagcctcctagagaaaaatcctacagttgtttttgtgttaggtggcccaggcagtggaaagggtacccagtgtgcaaatattgtcgaaaattttgggtatactcacctcagtgctggtgatcttctgcgagcagaaatcaaatctggttctgaaaatggcacaatgattcagaatatgattaaagaaggaaaaattgttccctctgaggtaacaattaagctcttacaaaaagcaatgcaggaaagtggcaatgacaaatttcttattgatggttttccccgcaatgaggaaaaccgtgcagcatttgaaaaagtgacaggaatagaaccagcatttgtcctattttttgagtgccctgaggaagagatggagaggcgactacttagtaggaaccagggtagagaagatgacaatattgagacaataaggaagcgatttaaggttttcttggagtctagtcttcccgtgattaattattatgatgcaaagggaaaagttcgcaagattgatgctgcaaggcctatcgaagaggtatttgagacagtcaaaggaatttttggtccaaagaatgagaaggctgattga

SEQ ID NO: 971 - protein, 207 aa, Glycine max
MGTVEAANKDANGSLLEKNPTVVFVLGGPGSGKGTQCANIVENFGYTHLSAGDLLRAEIKSGSENGTMIQNMIKEGKIVPSEVTIKLLQKAMQESGNDKFLIDGFPRNEENRAAFEKVTGIEPAFVLFFECPEEEMERRLLSRNQGREDDNIETIRKRFKVFLESSLPVINYYDAKGKVRKIDAARPIEEVFETVKGIFGPKNEKAD

SEQ ID NO: 972 - DNA, 726 bp, Triticum aestivum
  CDS (1)..(726)
atggcggcgaacctagaggacgtgccgtcggtggatctcatcaccgaggtgctccgccgcgccaagtgcagctccaagcccgacaagcgcatcatcctcatcggtccacctggctctggaaagggtacgcagtcgccccttattaaggatgaatattgcttgtgccatttagccactggtgatatgctgagggctgctgttgctgctaagactcctctggggatcaaggctaaagaagctatgaacaagggagagcttgtttcagatgacttggttgttgggattatcgatgaagccatgaagaaaccctcttgccagaaaggttttatccttgatggcttccctagaactgttgttcaagcacaaaagctcgatgacatgctggcaaagcaaggtgctaaagttgacaaggttttaaacttcgcaattgatgatgcaatattggaagaacgaattactggccgctggatacacccatcgagtggcagatcttaccatacaaagtttgctcctccgaagactcctggagttgatgatgttaccggagagcccttgattcaaaggaaagatgacacagctgcggttttaaagtcaaggcttgaggctttccatatgcagaccgaacctgtgattgactactactccaagaatggcttggtggcaaatcttcatgcagagaaaccaccaaaggaagtgaccgttgaggtgcagaaagcccttcaatga

SEQ ID NO: 973 - protein, 241 aa, Triticum aestivum
MAANLEDVPSVDLITEVLRRAKCSSKPDKRIILIGPPGSGKGTQSPLIKDEYCLCHLATGDMLRAAVAAKTPLGIKAKEAMNKGELVSDDLVVGIIDEAMKKPSCQKGFILDGFPRTVVQAQKLDDMLAKQGAKVDKVLNFAIDDAILEERITGRWIHPSSGRSYHTKFAPPKTPGVDDVTGEPLIQRKDDTAAVLKSRLEAFHMQTEPVIDYYSKNGLVANLHAEKPPKEVTVEVQKALQ

SEQ ID NO: 974 - DNA, 858 bp, Triticum aestivum
  CDS (1)..(858)
atggcttcctccacggccgctgcagccgcagtcacatctctcttaccgccgcccgtgggtgccgagaggccggttccccagggccgcctcctcttccgcgcctcccgcgcccgctccagccccctacggctcaaccccgtccgacaccacgggctctcgccggcgcctagagcggccaaggctgtggaggcagcgaaggctgaccctctaaatgtcatgatagcgggagctccggcgtctgggaagggcacgcagtgcgagctaatcaaggccaaatatggtctggtgcacatttcagctggagatttgttaagggcagaaatcgccacaggcaccgacaatgggaagcaggccaaggagtttatggagaagggacagctggttcctgatgagatcgttgttaatatggtgaaggggcgtcttctgcaaccagatgctcaggaaaagggttggcttttggatggttacccgagaagttattcacaggcaatggcactggaaactcttggaatccggcctgacattttcattctattagatgttcccgatgaacttcttgttgaaagggtagttggcagacggctggatcctgaaactgggaaaatataccatctaaagtattctccacctgagaatgaagaaattgcatccaggcttacacaaagatttgatgatacagaagaaaaggttaagctgaggttgcagactcattatcaaaatatcgagtccttggtttcgatatatgaagatgttatagtcaaggtaaatggaaataccacggtggaagatgtattcggtgagatcgagaagctgctcacttccagccttgataagaaaacagaaatggtggctagctaa

SEQ ID NO: 975 - protein, 285 aa, Triticum aestivum
MASSTAAAAAVTSLLPPPVGAERPVPQGRLLFRASRARSSPLRLNPVRHHGLSPAPRAAKAVEAAKADPLNVMIAGAPASGKGTQCELIKAKYGLVHISAGDLLRAEIATGTDNGKQAKEFMEKGQLVPDEIVVNMVKGRLLQPDAQEKGWLLDGYPRSYSQAMALETLGIRPDIFILLDVPDELLVERVVGRRLDPETGKIYHLKYSPPENEEIASRLTQRFDDTEEKVKLRLQTHYQNIESLVSIYEDVIVKVNGNTTVEDVFGEIEKLLTSSLDKKTEMVAS

SEQ ID NO: 976 - DNA, 741 bp, Linum usitatissimum
  CDS (1)..(741)
atggcgagcccttcggcggcgactttggaagatgttcccatcgttgatctcatgaccgagctcctccgccgcatgaagtgtgccaccaaacctgacaagcgcctcattcttatcggtcctcctggatcaggaaaaggtactcaatcaccgatcattaaggatgagttctgcttgtgtcacttggctacaggggatatgttgagagctgctgttgcaggcaaaactcctcttggaatcaaggctaaggaggcaatggaaaagggacaacttgtttctgatgatttggtagttggaattattgatgaagcaatcaagaagccctcttgtcaaaaaggcttcattcttgatgggtttccacggactgtggtccaggcgcagaagcttgatgagatgcttgagaagcaaggagtcaaagttgataaggtgctgaattttgccattgatgattctattttggaagagagaattactggtcgctggatccacccttcaagtggtagaacctatcacaccaaatttggacctcccaagaaccctggtgttgatgatgtaactggagaaccgttgatccagcggaaggatgacacagctgcagtcctaaagattaggctggaggcattccataagcagactgaacccgtgattaactattacaagcaaaagggtgctgttgcggatctccacgcagagaaagctcccaaagaggtcacagctgaggttgagaaagcgctttcctcctga

SEQ ID NO: 977 - protein, 246 aa, Linum usitatissimum
MASPSAATLEDVPIVDLMTELLRRMKCATKPDKRLILIGPPGSGKGTQSPIIKDEFCLCHLATGDMLRAAVAGKTPLGIKAKEAMEKGQLVSDDLVVGIIDEAIKKPSCQKGFILDGFPRTVVQAQKLDEMLEKQGVKVDKVLNFAIDDSILEERITGRWIHPSSGRTYHTKFGPPKNPGVDDVTGEPLIQRKDDTAAVLKIRLEAFHKQTEPVINYYKQKGAVADLHAEKAPKEVTAEVEKALSS

SEQ ID NO: 978 - DNA, 900 bp, Linum usitatissimum
  CDS (1)..(900)
atggctgcccttctcaaaatctccaaatccgcatcggcgccattgacatcagcctccagagctttcgcttccttcacctctcgtagtttctccgctctcaatacagagcccgaccttgccagatctcctcctccctcatccttcttatctcacaacaacaattccttgcctctccgtcaggaccccaaggatagaaacgtccagtgggtgttcctcggctgccccggcgtcgggaaaggaacttacgcctcccgcttgtccactctcctcggcgtccctcatatcgccaccggggatctcgtccgcgaagagctcaattcctccggtcccctcgcctcccagctcaaggagattgtgaatcaagggaaactggtttcagatgaaatcataataaacttgttatctaaacgtctggaaacaggggaagctaagggggaatctggattcattcttgatggctttcctcgtacaattaggcaagcggaaatattggaaggagtgacggaaatggatttggtggtgaacctaaagctgagggaagaagcgctgcttgcgaaatgtcttggtcgtaggatatgcagccagtgtggtggaaactacaatattgcctgcatagacatcaagggggagaatggagagcctagtatctacatggatcctcttcctcctccttcgcaatgtgccagcaaacttatccaacgccctgacgacactgaagaagtcgttaaggcgcggttaagaatttataacgagacgagtcggccggtggaggaattctaccgcagccgtgggaagttgttggagttcagtcttccaggtgggatcccggagtcgtggccgaagctgcttgaagcattgaatctcgatgatcaggaagtgaaacgctccgcagcagcttga

SEQ ID NO: 979 - protein, 299 aa, Linum usitatissimum
MAALLKISKSASAPLTSASRAFASFTSRSFSALNTEPDLARSPPPSSFLSHNNNSLPLRQDPKDRNVQWVFLGCPGVGKGTYASRLSTLLGVPHIATGDLVREELNSSGPLASQLKEIVNQGKLVSDEIIINLLSKRLETGEAKGESGFILDGFPRTIRQAEILEGVTEMDLVVNLKLREEALLAKCLGRRICSQCGGNYNIACIDIKGENGEPSIYMDPLPPPSQCASKLIQRPDDTEEVVKARLRIYNETSRPVEEFYRSRGKLLEFSLPGGIPESWPKLLEALNLDDQEVKRSAAA

SEQ ID NO: 980 - DNA, 867 bp, Linum usitatissimum
  CDS (1)..(867)
atggcagcaggagctacagcttgtgctagcagctcctacggcgcgaaattgagagcaaatttcagcaattgcggcggcagctccacggaaacggtgtcgtctctctgtttcaagccgttccggaagtccgatttctcgctccggatggcgaattcgagaaatagagctcaggttgttttagcttccggtaaggccgacccacctcttagaatcatgatttccggtgctccggcgtctggtaaaggtactcaatgtgagctgattactaaaaagtatgacttggtgcacattgctgctggagacttgctgcgagaagagattgcttcagggagcgagaatgggaagcgagccaaggaatacatggagaaagggcagttggttcctaatgaaatagttgtgatgatggttaaagaccggctgatgcagcccgactcgcaagaaaaaggatggctattagatggataccctcggagcatgtctcaagcaactgctctcaaagaatacggctttcagcctgatattttcatcgtcttggaagtcccagaagatatccttgttgaaagagttgttgggcgtagactggaccccgtaactggcaagatctaccacttgacttactccccgcccgagactgaagagatcgctgccaggctcactcaacgtttcgacgatactgaagagaaggtgaagttgcggttgaatacccataaccagaacgtggaggcagtgctttcgatgtacgaggatattactttgaagatcaaagggaatgtctccaaagaagaggtatttgcccaaatcgacagcaccctgtcaaaattgctcgagagtcaaaaggcagcaactcctgaatctcaagctgcttga

SEQ ID NO: 981 - protein, 288 aa, Linum usitatissimum
MAAGATACASSSYGAKLRANFSNCGGSSTETVSSLCFKPFRKSDFSLRMANSRNRAQVVLASGKADPPLRIMISGAPASGKGTQCELITKKYDLVHIAAGDLLREEIASGSENGKRAKEYMEKGQLVPNEIVVMMVKDRLMQPDSQEKGWLLDGYPRSMSQATALKEYGFQPDIFIVLEVPEDILVERVVGRRLDPVTGKIYHLTYSPPETEEIAARLTQRFDDTEEKVKLRLNTHNQNVEAVLSMYEDITLKIKGNVSKEEVFAQIDSTLSKLLESQKAATPESQAA

SEQ ID NO: 982 - DNA, 882 bp, Linum usitatissimum
  CDS (1)..(882)
atggctgctcttttcagaatctcagaatcttcatcggcgcctttgaaaactatctccagagctttcgcctcccggaatttctctgccttcaatcacgagcctgacctcacaaattccccgtcctctttatttcctcagaatccttctttgcctctgtgccaaaaccccaaggataagagcgtccagtgggtgttcctaggctgcccaggcgtcgggaaaggaacttatgcctctcgcttgtccactctcatcggcgttcctcacatcgccaccggcgatctcgtccgtgaagagctcaattcatacggtcctcttgcctcccagctgaaggagattgtcaatcaagggaaactggtttcagatgaaatcataattaacttactatccaagcgtcttgaagctggtgaagctaagggagaatccggtttcattcttgatggcttcccccgtacaattaggcaagcggaaatattggaaggagtcacagacattgatttggttgtgaacctgaagcttagggaagaagctctccttgcaaaatgccttggtcgtaggatttgcagccagtgtggtgggaactacaatgttgcctgcattgacatcaagggggacaatggtcaacctggaatctatatggctgctcttcctccacctccacaatgcgccgaaaaacttatccaacgagctgatgatactgaagaagtcgtcaaggcacggttacgcatttacaatgagatgagtaaacccttggaggggtattaccgcagtcgcgggaagctgttggagttcagtcttccaggggggataccagaatcatggccgaagctgcttgaagcattgaatcttgaagatcatgaagtggaacgctctgcggcagcttga

SEQ ID NO: 983 - protein, 293 aa, Linum usitatissimum
MAALFRISESSSAPLKTISRAFASRNFSAFNHEPDLTNSPSSLFPQNPSLPLCQNPKDKSVQWVFLGCPGVGKGTYASRLSTLIGVPHIATGDLVREELNSYGPLASQLKEIVNQGKLVSDEIIINLLSKRLEAGEAKGESGFILDGFPRTIRQAEILEGVTDIDLVVNLKLREEALLAKCLGRRICSQCGGNYNVACIDIKGDNGQPGIYMAALPPPPQCAEKLIQRADDTEEVVKARLRIYNEMSKPLEGYYRSRGKLLEFSLPGGIPESWPKLLEALNLEDHEVERSAAA

SEQ ID NO: 984 - DNA, 726 bp, Zea mays
  CDS (1)..(726)
atggcggcgaatctggaggacgtgccgtcactggatctgatgcacgagctgctccgccgcatgaagtgcagctccaagcccgacaagcgcctcatcctcatcggtccacctggctctggaaagggaactcagtctcctattatcaaggatgactattgcttgtgccatttagccactggtgatatgctgagggctgctgtggcggccaagacacctctaggtatcaaagctaaagaagctatgaataagggagagcttgtttcagatgatttggttgtgggcattattgatgaagctatgaagaaaccctcatgccagaaaggtttcattcttgatggctttcctagaactgtcactcaagcacagaagcttgatgagatgttggcaaagcaaggtgccaatgttgacaaagtcctgatctttgcaattgatgatgctgtattggaagaacggattactggtcgttggatccactcagccagtggtaggacttaccactcaaaatttgcacctccaaagtctccaggagttgatgatgtaactggagagccattgattcaaaggagagatgacaccgctgaggtcttgaagtcaaggcttgaagctttccacagacaaaccgaacctgtgattgattattactccaagaagggcttagtggtgaacctgcctgcagagaaaccaccgaaggaagtgactgctgaggtgcagaaagccctctcgtga

SEQ ID NO: 985 - protein, 241 aa, Zea mays
MAANLEDVPSLDLMHELLRRMKCSSKPDKRLILIGPPGSGKGTQSPIIKDDYCLCHLATGDMLRAAVAAKTPLGIKAKEAMNKGELVSDDLVVGIIDEAMKKPSCQKGFILDGFPRTVTQAQKLDEMLAKQGANVDKVLIFAIDDAVLEERITGRWIHSASGRTYHSKFAPPKSPGVDDVTGEPLIQRRDDTAEVLKSRLEAFHRQTEPVIDYYSKKGLVVNLPAEKPPKEVTAEVQKALS

SEQ ID NO: 986 - DNA, 630 bp, Linum usitatissimum
  CDS (1)..(630)
atgggatccgccgttgaagctggaaacacgataaaatatgcaagtttagctgagaagaagccgactgttgttttcgtgctgggtggcccgggtagtggaaagggtacacagtgcacaaacattgtggagcacttcggttatacccatctaagtgctggtgatcttcttcgagcagagatcaagtctggatctgacaatggaaccatgatccagaacatgattaaggagggaaagattgtgccctccgaggtgacaataaagctgctcgagaaggcaatactggataatggaaatgacaaattccttattgatggttttccccgtaatgaggaaaacagagctgcatttgaagctgttaccaaaatcgagccggaattcgtcctctttttcgattgtccagatgaagagatggaaaggaggattctgagtaggaaccagggaagagaagatgataacattgagacaataaggaagcgttttaaggtctttcttgagtctagccttccagtgattgagtactatgcttccaagggtaaagttaagaaggttgatgctgccaaatctgtcgaagaggttttcgaggcagtgaaggtcatttttaccccgaaagaggataaggctcatgtctaa

SEQ ID NO: 987 - protein, 209 aa, Linum usitatissimum
MGSAVEAGNTIKYASLAEKKPTVVFVLGGPGSGKGTQCTNIVEHFGYTHLSAGDLLRAEIKSGSDNGTMIQNMIKEGKIVPSEVTIKLLEKAILDNGNDKFLIDGFPRNEENRAAFEAVTKIEPEFVLFFDCPDEEMERRILSRNQGREDDNIETIRKRFKVFLESSLPVIEYYASKGKVKKVDAAKSVEEVFEAVKVIFTPKEDKAHV

SEQ ID NO: 988 - DNA, 726 bp, Hordeum vulgare
  CDS (1)..(726)
atggcggcgaacctcgaggacgtgccgtcggtggatctcatcaccgaggtgctccgccgcgccaagtgcagctccaagcccgacaagcgcatcatcctcgtcggtccacctggctctggaaagggtacacagtcaccccttattaaagatgaatattgcttgtgccatttagccactggtgatatgctgagggctgctgtcgctgctaagactcctctggggatcaaggctaaagaagcaatgaacaagggagagcttgtttcagatgacttggttgttgggattattgatgaagccatgaagaaaccttcatgccagaaaggttttatccttgatggcttccctagaactgttgttcaagcacaaaagctcgatgacatgctggcaaggcaaggcgctaaagttgacaaggttttgaactttgcaattgatgatgcaattttggaagaacgaattactggccgttggatacacccatcgagtggtagatcttaccatacgaagtttgctcctccgaagactcctggagttgatgatgttaccggagagcccttgattcaaaggaaagatgacacagctgcggtcttaaagtcaaggcttgaggctttccatatgcaaactgaacctgtgattgactactactccaagaatgggttggtggtaaatcttcatgcggagaaaccaccaaaggaagtgaccgttgaggtgcagaaagccctttcatga

SEQ ID NO: 989 - protein, 241 aa, Hordeum vulgare
MAANLEDVPSVDLITEVLRRAKCSSKPDKRIILVGPPGSGKGTQSPLIKDEYCLCHLATGDMLRAAVAAKTPLGIKAKEAMNKGELVSDDLVVGIIDEAMKKPSCQKGFILDGFPRTVVQAQKLDDMLARQGAKVDKVLNFAIDDAILEERITGRWIHPSSGRSYHTKFAPPKTPGVDDVTGEPLIQRKDDTAAVLKSRLEAFHMQTEPVIDYYSKNGLVVNLHAEKPPKEVTVEVQKALS

SEQ ID NO: 990 - DNA, 645 bp, Hordeum vulgare
  CDS (1)..(645)
atgagcacagccgtggatgcttcattacctgtcgccgagcaggaggatggtactgcgaatatgttgggtgggaagaaagttgcagttgtatttgttctaggtggtcctggaagtggaaaaggtacacaatgtagcaatattgtggagcatttcggatttacacatcttagtgctggagagctgttgcgctcagaaatcaagtctggttctgagaatggaaccatgattgacagcattataaaggaagggaaaattgttccatctgagataaccgtaaagctcttgcaagaagctatgataaaaagtgaaaataacaaattcctcattgatggatttccaaggaatcaagaaaaccgtctgtcatttgagaatgttataaaaatagctcctgagtttgtgctattctttgactgttctgaggaagagatggtaagacgtcttctgggtcgaaatcagggacgagctgacgataacattgagactatcagaaaaagattcagagtttttgaagaatcaagtttgcctgtagttcagtactatgactctaagggcaaggttaagaagattaatgctgcaaaaccaatccctgaggtgtttgaagatgtgaaaaccatttttcagccttatggctcaaaggccgcatag

SEQ ID NO: 991 - protein, 214 aa, Hordeum vulgare
MSTAVDASLPVAEQEDGTANMLGGKKVAVVFVLGGPGSGKGTQCSNIVEHFGFTHLSAGELLRSEIKSGSENGTMIDSIIKEGKIVPSEITVKLLQEAMIKSENNKFLIDGFPRNQENRLSFENVIKIAPEFVLFFDCSEEEMVRRLLGRNQGRADDNIETIRKRFRVFEESSLPVVQYYDSKGKVKKINAAKPIPEVFEDVKTIFQPYGSKAA

SEQ ID NO: 992 - DNA, 630 bp, Helianthus annuus
  CDS (1)..(630)
atggggaccgttgaagctgcaaccaagcaagcaattgaaagtactcttgctcaaaagaagcccaaggttgtatttgtcctaggaggcccaggcagtggaaagggtacacaatgtgcaaacatcgtcgagcattttggatatactcatcttagtgccggagatcttcttcgtgcagaaataaaatccggctctgaaaacgggaccatgattcagaacatgatcaaggagggaaagattgtaccatcggaagtaacaatcaagcttcttgaaaaagcaatcttggaaaatgaaaatgacaaatttttaattgatggattcccacgtaatgaggaaaaccgtgcagcatttgaggctgtcactggaatttcacccgagtttgttctcttctttgattgccctgaggaagagatggagaagcgacttttgggtcgcaatcagggtagagaagacgataatatcgacaccatcaggaagcgctttaaagtttttctggaatcaagtcttccagttatcgaatattacaactctaaggggaaggtccgaaagattgacgctgccaaacctgttggagaagtttttgaagcagtcaaggctctgttcactccagtggatgagaaggctgcagcttag

SEQ ID NO: 993 - protein, 209 aa, Helianthus annuus
MGTVEAATKQAIESTLAQKKPKVVFVLGGPGSGKGTQCANIVEHFGYTHLSAGDLLRAEIKSGSENGTMIQNMIKEGKIVPSEVTIKLLEKAILENENDKFLIDGFPRNEENRAAFEAVTGISPEFVLFFDCPEEEMEKRLLGRNQGREDDNIDTIRKRFKVFLESSLPVIEYYNSKGKVRKIDAAKPVGEVFEAVKALFTPVDEKAAA

SEQ ID NO: 994 - DNA, 633 bp, Helianthus annuus
  CDS (1)..(633)
atggggactagcgttgatgctgcacatacggaaggaaccgaaagcgctcttagtgtaaagaagcccaaagttgtgtttgttctaggaggcccgggcagtggcaagggtacacaatgtgcaaatatcgtagaacactttgggtatacgcatctcagtgccggagatcttctccgggccgaaataagttccggatctgaaaacgggaccatgatccagaacatgatttctgaaggagtaatcgttccgccagaagtaaccattaagcttcttgaaaaagcaattatggaaagtgagaacgacaagttcctgatcgacgggtttccccgtaatgaggaaaaccgtgcaatgtttgagtcagtcaccggaattgtacccgagtttgttcttttctttgattgttctgaggaagagatggagaggcgcctcttaagccgcaaccagggaagagtagatgataacattgacacaataaggaagcggtttaaggttttcgttgaatctagtctctttgttatcaactattacaactcaaaggggagggtcagaaagatcgatgccgctaagccggttgccgaagtttttgaagcagttaaggctgttttcacccctgttgatgacaaggctgctgcctag

SEQ ID NO: 995 - protein, 210 aa, Helianthus annuus
MGTSVDAAHTEGTESALSVKKPKVVFVLGGPGSGKGTQCANIVEHFGYTHLSAGDLLRAEISSGSENGTMIQNMISEGVIVPPEVTIKLLEKAIMESENDKFLIDGFPRNEENRAMFESVTGIVPEFVLFFDCSEEEMERRLLSRNQGRVDDNIDTIRKRFKVFVESSLFVINYYNSKGRVRKIDAAKPVAEVFEAVKAVFTPVDDKAAA

SEQ ID NO: 996 - DNA, 1138 bp, Brassica napus
  CDS (79)..(708)
  misc_feature (788)..(788): n is a, g, c or t
  misc_feature (1092)..(1092): n is a, g, c or t
  misc_feature (1095)..(1095): n is a, g, c or t
  misc_feature (1129)..(1129): n is a, g, c or t
gattctcacattctcagcgattaatcaaaaactttctccgtcttcagttaacatttgaacgagttgcttaatagtaccatgggatccattgctgatgctgcaaacaaggaggttaatggaaccgcaagtgagaagagacccgctgttatttttgtccttggtggtccaggaagtgggaaaggtacacagtgtgcctatattgttgaccattttggttacacacatctgagtgctggagaccttctcagggctgaaattaaatcaggttctgaaaatgggactatgatccagaatatgattaaagaagggaagattgtaccttctgaggttacaatcaagcttcttcagaaagcaattcaggagaacgggaacgacaagttcctcattgatggcttccctcgcaatgaggagaaccgagcagcctttgaaaaagttactgggattgaacctaagtttgtcttgttctttgattgtcctgaggaagagatggagaggcgcctcttgggaagaaaccaggggagagaggatgacaatatagagactataaggaagcgtttcaaggtgtttcttgaatctagcttgccagtgattcagtactacgaagctaagggcaaagttcgcaagattcatgccgcaaagcctattgaagatgtgtttcaggaggtgaaggcagtcttttctcctgaagctgagaaggttgaagcctaaggcagcagcatcgtgaagtaaagacatgtcggataaattgatcaggtatgtatgtaagtgtgagagcagtgagaggatgntcgagcattttcttttattctgatctataaaagtaaaaaagtgtaacttgagaatctagaataaagggtttggaagctgatgcctttgttatagccatttaagatcatatgtatggtatctagttctctaagaatctttgacaggagcatgtgatgattattaatgtttgctttctttaaaagatttgcaggtagctgggtggttgcatctttctttactgggaagtctctgcttggccttatttttttcttctatataactatatgatatgattactgttattattatacacattgttacctnttnatatcatttttgattttgtatttgatgggatttntgattggct

SEQ ID NO: 997 - protein, 209 aa, Brassica napus
MGSIADAANKEVNGTASEKRPAVIFVLGGPGSGKGTQCAYIVDHFGYTHLSAGDLLRAEIKSGSENGTMIQNMIKEGKIVPSEVTIKLLQKAIQENGNDKFLIDGFPRNEENRAAFEKVTGIEPKFVLFFDCPEEEMERRLLGRNQGREDDNIETIRKRFKVFLESSLPVIQYYEAKGKVRKIHAAKPIEDVFQEVKAVFSPEAEKVEA

SEQ ID NO: 998 - DNA, 1070 bp, Brassica napus
  CDS (99)..(836)
ggtcgtgggagataaacgcagctttggggcattggaagcatcgaatctacatgcactccacacaaaactaaatctaattcctcaagaagacgaccaacatggcgaaaagcagtgtagacatggaagacattcagacagtcgatctcatgtcagagctcctccgtcgcatgaagtgtgcctctaaacctgacaaacgtctcgttttcatcggcccacctggttcaggaaaaggtacgcagtctccggtcataaaggatgagttctgcttgtgccatttgtctaccggtgacatgcttagagctgctgttgctgctaagtcccctcttggtgtcaaggcgaaggaagctatggacaagggagagcttgtttctgatgacttggttgttggaatcatggatgaagcaatgaacagacccaaatgtcagaaaggtttcattcttgatgggtttcctaggaccgtcacacaagctgagaagcttgatgagatgcttaatagaagaggagctcagattgacaaagtgcttaattttgcaatcgacgattcggttcttgaagaaagaattactggaaggtggattcacccttcaagtggaaggagctatcataccaaattcgcacctcctaaagttcctggagtcgatgatgtgactggagagccattgattcaacgtaaagatgacaatgcggatgttcttaggtcaaggctggatgcattccacaagcagacgcaaccggttattgactactacgcgaagaaggggaatctggtgaacataccagcagagaaggctccggaagaggttaccaaagtggtgaagaaggttgtgtctgcatgagaactgtaataaatttggcatgagaattgagttctgaatctctcttatgtttgttttctttttgaataaatctcctgaggtttttgttctcctggaatgtcttctacttgagagcaaacattttgctgcaacttttgtgcagtgttttcactaaattgtttgttcacgtctacccagtaaaaaaaaagaagcaaaatgaaataaaagttttttaaagaaaaaaaaaaaaaaaaa

SEQ ID NO: 999 - protein, 245 aa, Brassica napus
MAKSSVDMEDIQTVDLMSELLRRMKCASKPDKRLVFIGPPGSGKGTQSPVIKDEFCLCHLSTGDMLRAAVAAKSPLGVKAKEAMDKGELVSDDLVVGIMDEAMNRPKCQKGFILDGFPRTVTQAEKLDEMLNRRGAQIDKVLNFAIDDSVLEERITGRWIHPSSGRSYHTKFAPPKVPGVDDVTGEPLIQRKDDNADVLRSRLDAFHKQTQPVIDYYAKKGNLVNIPAEKAPEEVTKVVKKVVSA

SEQ ID NO: 1000 - DNA, 1199 bp, Brassica napus
  CDS (73)..(918)
tcccgggtcgacgatttcgtcgttcaagcgatctcaagccgctcctctctctctctctctatcatctctgaaatggcgagagtactgcgtgtggcgagatcctcctcctccctcttcagcttcggaagcagatcttattcagccgaagctagccacgtgtcctctccccctcctccgtttcttggagctcgcagagacgttaccaaggagagaaacgtgcagtgggtgttcctcggttgtcccggtgtcgggaaaggcacttacgccagcagactctcgagtctcctcggtgttcctcacatcgccaccggagatctcgtccgtgatgcgctagcttcctccggacctctctcccgacagctatcagagattgtaaaccaggggaagcttgtttctgatgagatcatagtgaacctattatcaaagagacttgaagctggtgaagccaaaggtgaatcaggtttcattcttgatggctttcctcgtaccatgagacaagctgaaatactaggagacgtcactgacatcgatctagtggtgaacttgaagctacctgaggaggttttggttgacaaatgcctagggaggagaacgtgtaatcaatgcggcaaaggtttcaatgtagctcacatcaacttaaagggtgagaatgggaaacctacaatcagcatggatccgcttctccctccgcctcggtgtatgtcaaagctcatcactcgagctgacgatactgaagaggttgtgaaagcaaggctccgtatttacaatgaaaccagccagcctcttgaagagtactaccgtagcaaaggaaagctgatggagtttgacttacctggaggcatccctgagtcatggccaaggctattagaagccttaaggcttgatgattacgaggagaaacaatctgccgcggcatagttcaactacaacaccggtatttataattctttgcatgtggaagacatgtgcctatatcagttttgtgttggaaaataaagaaaaccttagattgtttttttttattgcctcagatcagaataatcatcatcatacacactttgcaaactatatgatgtatcatgattgtttatgagtttgctagttacaggaatgtataaacactttggtacacttttgattatttattggtgaatgtgatcaatgattgttcaaaaaaaaaaaaaaaaaaaaaaaaaaaa

SEQ ID NO: 1001 - protein, 281 aa, Brassica napus
MARVLRVARSSSSLFSFGSRSYSAEASHVSSPPPPFLGARRDVTKERNVQWVFLGCPGVGKGTYASRLSSLLGVPHIATGDLVRDALASSGPLSRQLSEIVNQGKLVSDEIIVNLLSKRLEAGEAKGESGFILDGFPRTMRQAEILGDVTDIDLVVNLKLPEEVLVDKCLGRRTCNQCGKGFNVAHINLKGENGKPTISMDPLLPPPRCMSKLITRADDTEEVVKARLRIYNETSQPLEEYYRSKGKLMEFDLPGGIPESWPRLLEALRLDDYEEKQSAAA

SEQ ID NO: 1002 - DNA, 1081 bp, Brassica napus
  CDS (73)..(918)
tcccgggtcgacgatttcgtcgttcaagcgatctcaagccgctcctctctctctctctctatcatctctgaaatggcgagagtactgcgtgtggcgagatcctcctcctccctcttcagcttcggaagcagatcttattcagccgaagctagccacgtgtcctctccccctcctccgtttcttggagctcgcagagacgttaccaaggagagaaacgtgcagtgggtgttcctcggttgtcccggtgtcgggaaggggacttacgccagcagactctcgagtctcctcggtgttcctcacatcgccaccggagatctcgtccgtgatgcgctagcttcttccggacctctctcccgacagctatcagagattgtaaaccaggggaagcttgtttctgatgagatcatagtgaacctattatcaaagagacttgaagctggtgaagccaaaggtgaatcaggtttcattcttgatggctttcctcgtaccatgagacaagctgaaatactaggagacgtcactgacatcgacctagtggtgaacttgaagctacctgaggaggttttggttgacaaatgcctagggaggagaacgtgtaatcagtgcggtaaaggtttcaatatagctcacatcaacttaaaaggcgagaatgggaaacctggaatcagcatggatccgcttctccctccgcctcagtgtatgtcaaagctcgtcactcgtgctgatgatactgaggaggttgtgaaagctaggctccgtatttacaatgaaaccagccagcctcttgaagagtactaccgtagcaagggaaagcttatggagtttgacttacctggaggcatcccagagtcttggccaaggctgttagaagccttgaggcttgatgattacgaggagaagcaatctgctgcggcttagttcaacttcaccaccggtatttataattctttgcatgtggaagacatgtgcctatatcagttttgtgttggaaataaagaaaaccttagattgttttattgcctcagatcagaataatcatcatcatacacactttgcaaactatatgatgtatcatgattgt

SEQ ID NO: 1003 - protein, 281 aa, Brassica napus
MARVLRVARSSSSLFSFGSRSYSAEASHVSSPPPPFLGARRDVTKERNVQWVFLGCPGVGKGTYASRLSSLLGVPHIATGDLVRDALASSGPLSRQLSEIVNQGKLVSDEIIVNLLSKRLEAGEAKGESGFILDGFPRTMRQAEILGDVTDIDLVVNLKLPEEVLVDKCLGRRTCNQCGKGFNIAHINLKGENGKPGISMDPLLPPPQCMSKLVTRADDTEEVVKARLRIYNETSQPLEEYYRSKGKLMEFDLPGGIPESWPRLLEALRLDDYEEKQSAAA

SEQ ID NO: 1004 - DNA, 1218 bp, Brassica napus
  CDS (70)..(927)
aattcccgggtcgacgatcccgtccaccacaagcctcgttcgttgagcgagggagagagcgagagagagatggcgtgctgtgtgaactatatctctccgccacgtgcctctctatctccaccaccttcacgctcctccttctccggcgatgccttgcactctctcctccgtgaaccaaccttactcctccgacgtcattcgagatctccgtcgatcgtcgctcccagattccaggttgtggcggccgagaaagcagagccgcctctgaagattatgatatcaggagctcccgcttcgggtaaaggcacacagtgcgagctcatcactcagaaatatggtttggtgcatatctctgctggagacttgctcagagctgagatcgcttctgggagtgaaaacggaaagctggcaaaagaatacatggagaaaggacagctggtccctgatgagatagttgtaatgatggtaaaagatcgtttatcacaaactgattcacagcagaaaggttggcttttagatggttatccgagaagctcatcgcaggcaacagctcttaaagggtttggattccagcctgatctgttcattgtcctcgaagttcctgaagatattctaatcgaaagagttgtggggcgtagattagatcctgttacgggaaagatctaccacttgaagtattctcctccagagacagaagagatctctgctaggctcacccaacgttttgatgataccgaagagaaggcaaagctgcggctgaagacacataaccaaaatgtgagcgatgtgctttccatgtacgatgatatcactattaagattaagggaaaccgttcaaaggaggaagtgtttgctcaaattgatactgctctatcccaaatgctccaacagaggaacaacacctctccaagttcactttcaagttgaatcattcttggtactgacctgaggaaggagtgtttgattatttccgaaatgcttcaacagagggaacactgctcgaacttcactttcaagttgaatcattcttgtcacggacctaaccagcggtaaatatcccctttctcgcatttatcaaattctattgataccacttgtatctcacaataaggatctatttgtttccagtaagattgatgtgtgtctgtgacctttatgctcttgtagatttactgaaaaaaataactcattgtatttctcttgttgcaatcatgaaga

SEQ ID NO: 1005 - protein, 285 aa, Brassica napus
MACCVNYISPPRASLSPPPSRSSFSGDALHSLLREPTLLLRRHSRSPSIVAPRFQVVAAEKAEPPLKIMISGAPASGKGTQCELITQKYGLVHISAGDLLRAEIASGSENGKLAKEYMEKGQLVPDEIVVMMVKDRLSQTDSQQKGWLLDGYPRSSSQATALKGFGFQPDLFIVLEVPEDILIERVVGRRLDPVTGKIYHLKYSPPETEEISARLTQRFDDTEEKAKLRLKTHNQNVSDVLSMYDDITIKIKGNRSKEEVFAQIDTALSQMLQQRNNTSPSSLSS

SEQ ID NO: 1006 - DNA, 1348 bp, Glycine max
  CDS (166)..(894)
attgaacaaaggagacgacaaacgtgtgtagctaaacaaagggcaagagacggcgagttgagttttgaaagcgtgtgcgtgggagggtccgaagttggagatagtgattctggttctgttctgttcttctttctactcacaacaacatcagaatcagaaacaacaatggccaacactaacttggaagatgttccctctctggatctcatgactgagctccttcgtcgtctcaagtgctcttccaaacctgacaagcgtcttattctcattggcccacctggatctggaaaaggcacccagtcaccaatcataaaagatgagtactgcttatgccacttagctactggtgatatgttaagagcagctgtagcagctaagacccctcttggtgtcaaggctaaagaagctatggataagggagaacttgtttctgatgacttggttgttggcattatagatgaagcaatgaagaaaccatcatgtcagaaaggtttcattcttgatggttttccaagaactgtggtccaagcacagaagcttgatgagatgctgcaaaaacaaggagttaaagttgataaggtgctcaattttgcaattgatgatgcaatccttgaggagcgaattactggtcgctggatacacccatccagtggcagaacttaccatacaaaattttcccctccaaaggttcttggtgttgatgatgttactggtgaaccacttatccagcgcaaggatgacactgcggctgttcttaagtcaagactggaggcatttcacaagcaaaccgaaccggttattgattactattcaaagaagggccttgttgctaatcttcatgctgagaaaccacccaaagaggtgacagttgaagtggagaaagtgctgtcttaaatggagatcacccttcgatcctggggctcgaactgcaattgttcttttttcgctacaggaaaacttttcgttgccaatttgtattttaatatactctgaaatccgcttacctttcagctttactgcaaatgccggctgttctcaaacccacattcgaagaccaactttgatgaatcaaaaagtctatttattttgaattttggtctctttcttttttctgcatgaatttccactcgacattcgcaggtgtttacgcacccgtgaaacttttgatttcatgaactagttggcaaaatttgagctacttattgttgggaagcatttgtgctgcttttgaaggtgtgaaatgaaaatttgtaagaaataattgtttggtctgtgtttcattattttatttctatatatgtttgatattaattgaataataagttttactatatttttcaaaaaaaaa

SEQ ID NO: 1007 - protein, 242 aa, Glycine max
MANTNLEDVPSLDLMTELLRRLKCSSKPDKRLILIGPPGSGKGTQSPIIKDEYCLCHLATGDMLRAAVAAKTPLGVKAKEAMDKGELVSDDLVVGIIDEAMKKPSCQKGFILDGFPRTVVQAQKLDEMLQKQGVKVDKVLNFAIDDAILEERITGRWIHPSSGRTYHTKFSPPKVLGVDDVTGEPLIQRKDDTAAVLKSRLEAFHKQTEPVIDYYSKKGLVANLHAEKPPKEVTVEVEKVLS

SEQ ID NO: 1008 - DNA, 1189 bp, Glycine max
  CDS (288)..(911)
gcagcaggctgccacctttttgaattgtcagttgttggttcttcctttcaattacctgggaatacctattggggcaaaccctaagcttgtacctttcccccaaaaaataaaaagcacaccttcattcgttcctctttctttcttccaactctataaatatcaatcaaaattcccctccacactcattctcccatcgttttccctctctctccctctctctctctccctctctctctcatacttattctccctcgcgcgaaagataaacacatttttagttgcaactaatgggaactgttgaagctgcaaacaaggatgcaaatggaagcctcctagagaaaaatcctacagttgtttttgtgttaggtggcccaggcagtggaaagggtacccagtgtgcaaatattgtcgaaaattttgggtatactcacctcagtgctggtgatcttctgcgagcagaaatcaaatctggttctgaaaatggcacaatgattcagaatatgattaaagaaggaaaaattgttccctctgaggtaacaattaagctcttacaaaaagcaatgcaggaaagtggcaatgacaaatttcttattgatggttttccccgcaatgaggaaaaccgtgcagcatttgaaaaagtgacaggaatagaaccagcatttgtcctattttttgagtgccctgaggaagagatggagaggcgactacttagtaggaaccagggtagagaagatgacaatattgaaacaataaggaagcggtttaaggttttcttggagtctagtcttcccgtgattaattattatgatgcaaagggaaaagttcgcaagattgatgctgcaagacctatcgaagaggtatttgagacagtcaaagcaatttttggtccaaagaatgacaaggctgattgagcatgttcatcttgactccatggtggaaatttagaggtcatatcagtattggcggcttgttctattgtgtcacattttgttattatagtatagaaaatcgtagtttatacctaagggttttacctctgtattctaatgtgttatatcttgttgactcattcattgatattgcaataaagattttcgtgtgggattatttctaccaatttatatatttacttatcccatttaaaaaaaaaaaaaaaaaaaaaaaaaaaaaaaaaaaaaaaaaaaaaaaa

SEQ ID NO: 1009 - protein, 207 aa, Glycine max
MGTVEAANKDANGSLLEKNPTVVFVLGGPGSGKGTQCANIVENFGYTHLSAGDLLRAEIKSGSENGTMIQNMIKEGKIVPSEVTIKLLQKAMQESGNDKFLIDGFPRNEENRAAFEKVTGIEPAFVLFFECPEEEMERRLLSRNQGREDDNIETIRKRFKVFLESSLPVINYYDAKGKVRKIDAARPIEEVFETVKAIFGPKNDKAD

SEQ ID NO: 1010 - DNA, 1594 bp, Glycine max
  CDS (189)..(1046)
gagagtgcgcagagagcatggcaataataccacattaccacttccaccctcaccttgctgagcctaagcaaatagtggataaataaattccgaaagcgaaaaaataattaacaggttaatcgattaatcaatcaccaccgtgtccgttgaatttgatcattcagcgcaactctgcaaatcacatcatcatggcggccataacccgcctcgcgaagcgcgcgtcagccttctcacccctgacgaggaggtgcctgagctcctccgaagtcaaatcccacgcgccgccgcacgacgccgcgtccttccgcccgtttccgcggcgcgaagatccgagcaagcggtgcgtgcagtgggcgttcctcggctgccccggcgtcggaaaaggaacgtacgctagtcgcctctcgaacctcctcggcgtccctcacatcgccaccggcgatctcgttcgcgacgaactcgcctcctctgaccccctttcttcccagctatcagaaattgtaaaacaaggtcaattggtgtcagatgaaattattataagtttattgtcaaagagacttgttgccggggaagctaaaggcgatctgggatttattcttgatggttttcctcgaacaattaagcaagcagaaatattggaaggggtaactgacattgacttggtaatcaatctgaagcttcgagaagatgttctgcttgagaaatgccttggtaggagaatttgcaatcagtgtgggggtaattttaatgttgcttctattaacatcaaggccgagaatgggagccctgaaattattatggctccacttcttcctcctgagaattgtatgtcaaagctcattactcgatcagatgatactgaatcagtggtcaaagaaaggcttcgaatatacaatgaaatgactcagcctgtggaggaattttaccgttcgagaggaaaattattggagtttaacctgcctggaggaatcccggaatcttggcctaagttgctacatgctcttaatcttgatgattacgaggacaaacgatctgctgcagcataaagatataataatgtatcataacagtaagtatttcattctttgcgtgcttatattgcatgcttggcaattttgcaggacagagaaccaaagcaagggaacttctctgctagtattattttggaccaatgatgatatttgtaagtgttgtaatctgataagactggtagtgttgcgttttgttttcgtataatttggttatatgggaagggtttcctagcatataatgttattgtgaagagtgaataatatatcacagtattgctagaaagatagttggtcaggaatcaacgtcgataggattggtgcatcatcactattgttgtaaattaaatgtgaatgaacttattctattacatcaacacatcatcacatgctcgtgatttagggaaggcttttttactggagtaacttccaggaaaaaaattatttaatatgatgtttcatgttatttgaataagtcttttgatttcacaatactaatgaataactcctccttttctttgaaaaaaaaaaaaaaaaaaaaagggcggccgctcagaggatcaagc

SEQ ID NO: 1011 - protein, 285 aa, Glycine max
MAAITRLAKRASAFSPLTRRCLSSSEVKSHAPPHDAASFRPFPRREDPSKRCVQWAFLGCPGVGKGTYASRLSNLLGVPHIATGDLVRDELASSDPLSSQLSEIVKQGQLVSDEIIISLLSKRLVAGEAKGDLGFILDGFPRTIKQAEILEGVTDIDLVINLKLREDVLLEKCLGRRICNQCGGNFNVASINIKAENGSPEIIMAPLLPPENCMSKLITRSDDTESVVKERLRIYNEMTQPVEEFYRSRGKLLEFNLPGGIPESWPKLLHALNLDDYEDKRSAAA

SEQ ID NO: 1012 - DNA, 807 bp, Glycine max
  CDS (1)..(804)
atggcggccataacccgcctcctaaatcgcacctcttccctctcttccgtggcgcgtggattctcatctcacgcatcgccgccgcgcaaggaggagaggaatgtccagtgggtgttcctgggttgccccggcgtcggaaaaggcacctacgccagtcgcctctgcaacctcctcggcgtccctcacatcgccaccggcgatctcgtccgccacgagctcgcctccaacggccccctttcttcccagctatcagaaattgttaatcaaggaaaattggtgtcagatgaaatcatcataagtttattgtcaaagaggctggctgatggggaagctaaaggagaatcgggatttattcttgatggttttccacgaacaataaagcaagcggaaatattggaaggggtaactgacattgacctggtggtcaatctgaagctccaagaagaagcactgcttgcaaaatgccttggtagaagaatttgcaatcaatgtggaggaaattttaatattgcctccattagcgtcaagggtgagaatgggcgtcctggaatggtcatggctccacttcttcctcctgcacactgtatgtcaaagctcattgctcggtcagatgatactgaatcagtagtcaaagaaaggcttcgtatatacaatgaaaagagtcagcctgtggagggattttaccgtagtagagggaaactgttggagtttgaactgccaggaggtatcccagaatcttggcctaagttgctgcaagctcttaatcttgatgattatgaggagaagcaatctgctgcagcataaaat

SEQ ID NO: 1013 - protein, 267 aa, Glycine max
MAAITRLLNRTSSLSSVARGFSSHASPPRKEERNVQWVFLGCPGVGKGTYASRLCNLLGVPHIATGDLVRHELASNGPLSSQLSEIVNQGKLVSDEIIISLLSKRLADGEAKGESGFILDGFPRTIKQAEILEGVTDIDLVVNLKLQEEALLAKCLGRRICNQCGGNFNIASISVKGENGRPGMVMAPLLPPAHCMSKLIARSDDTESVVKERLRIYNEKSQPVEGFYRSRGKLLEFELPGGIPESWPKLLQALNLDDYEEKQSAAA

SEQ ID NO: 1014 - DNA, 627 bp, Glycine max
  CDS (1)..(624)
atgggaactgttgaagctgcaaacaaggatgcaaatggaagtctcctagagaaaaatccttcagttgtttttgtgttaggtggcccaggaagtggaaagggtacccaatgtgcaaatattgtccaaaattttgggtatactcatctcagcgctggtgatcttctgcgagcagaaatcaaatctggttctgaaaatggtacaatgattcagaatatgattaaagaaggaaaaattgttccctctgaggtaacaattaagctcttacaaaaagcaatgcaggaaagtggcaatgacaaatttcttattgatggttttccccgcaatgaggaaaaccgggcagcatttgagaaagtgacaggaatagagccagcatttgtcttattttttgattgccctgaggaagagatggagaggcgacttcttagtaggaaccagggtagagaagatgacaatattgaaacaataaggaagcggtttaaggttttcttggagtctagtcttcccgtgattaattattatgatgcaaagggaaaagttcgcaagattgatgctgcaagacctatcgaagaggtatttgagacagtcaaaggaatttttggtccaaagaatgagaaggctgattgagca

SEQ ID NO: 1015 - protein, 207 aa, Glycine max
MGTVEAANKDANGSLLEKNPSVVFVLGGPGSGKGTQCANIVQNFGYTHLSAGDLLRAEIKSGSENGTMIQNMIKEGKIVPSEVTIKLLQKAMQESGNDKFLIDGFPRNEENRAAFEKVTGIEPAFVLFFDCPEEEMERRLLSRNQGREDDNIETIRKRFKVFLESSLPVINYYDAKGKVRKIDAARPIEEVFETVKGIFGPKNEKAD

SEQ ID NO: 1016 - DNA, 1281 bp, Glycine max
  CDS (161)..(1018)
  misc_feature (1100)..(1100): n is a, g, c or t
tgcaagcaaaatctaagttgaaaattttagatatttaaagcaaatattgtataaataaattccgaaagcgaaaaaataattaacaggttaatcgattaatcaatcaccaccgtgtccgttgaatttgatcattcagcgcaactctgcaaatcacatcatcatggtggccgtaacccgcctcgcgaagcgcgcgtcaaccttctcaccccagatgaggaggtgcctgagctcctccgaagtcaaatcccacgcgccgccgcacgacgccgcgtccttccgcccgtttccgcggcgcgaagatctgagcaagcggtgcgtgcagtgggcgttcctcggctgccccggcgtcggaaaaggaacgtacgctagtcgcctctcgaacctcctcggcgtccctcacatcgccaccggcgatctcgttcgcgacgaactcgcctcctctggccccctttcttcccagctatcagaaattgtaaaacaaggtcaattggtgtcagatgaaattattataagtttattgtcaaagagacttgttgccggggaagctaaaggcgatttgggatttattcttgatggttttcctcgaacaattaagcaagcagaaatattggaaggggtaactgacattgacttggtaatcaatctgaagcttcgagaagatgttctgcttgagaaatgccttggtaggagaatttgcaatcagtgtgggggaaattttaatgttgcttccatcaacatcaaggctgagaatgggagccctgaaattattatggctccacttcttcctcctgagaattgtatatcaaagctcattactcgatcagatgatactgaatcagtggtcaaagaaaggcttcgaatatacaatgaaatgactcagcctgtggaggaattttaccgttcaagaggaaaattattggagtttaacctgcctggaggaatcccggaatcttggcctaagttgctacatgctcttaatcttgatgattacgaggacaaacgatctgctgcagcataaagatataataatgtatcataacagtaagtatttcattctttgcgtgcttatattgcatgcttggcaattttgcaggacaganaaccaaagcaagggaacttctctgctagtattattttggaccaatgatgatatttgtaagtgttgtaatctgataagactggtagtgttgcgttttgttttcgtataatttggttatatgggaagggtttcctagcatataatgttattgtgaagagtgaataatatatcacagtattgct

SEQ ID NO: 1017 - protein, 285 aa, Glycine max
MVAVTRLAKRASTFSPQMRRCLSSSEVKSHAPPHDAASFRPFPRREDLSKRCVQWAFLGCPGVGKGTYASRLSNLLGVPHIATGDLVRDELASSGPLSSQLSEIVKQGQLVSDEIIISLLSKRLVAGEAKGDLGFILDGFPRTIKQAEILEGVTDIDLVINLKLREDVLLEKCLGRRICNQCGGNFNVASINIKAENGSPEIIMAPLLPPENCISKLITRSDDTESVVKERLRIYNEMTQPVEEFYRSRGKLLEFNLPGGIPESWPKLLHALNLDDYEDKRSAAA

SEQ ID NO: 1018 - DNA, 899 bp, Glycine max
  CDS (63)..(686)
cacgaggctctctctcattctcttctccatcgcgcgtaagaaacacattttagttgctactaatgggaactgttgaagctgcaaacaaggatgcaaatggaagtctcctagagaaaaatccttcagttgtttttgtgttaggtggcccaggaagtggaaagggtacccaatgtgcaaatattgtccaaaattttgggtatactcatctcagcgctggtgatcttctgcgagcagaaatcaaatctggttctgaaaatggtacaatgattcagaatatgattaaagaaggaaaaattgttccctctgaggtaacaattaagctcttacaaaaagcaatgcaggaaagtggcaatgacaaatttcttattgatggttttccccgcaatgaggaaaaccgtgcagcatttgagaaagtgacaggaatagagccagcatttgtcttattttttgattgccctgaggaagagatggagaggcgacttcttagtaggaaccagggtagagaagatgacaatattgaaacaataaggaagcggtttaaggttttcttggagtctagtcttcccgtgattaattattatgatgcaaagggaaaagttcgcaagattgatgctgcaagacctatcgaagaggtatttgagacagtcaaaggaatttttggtccaaagaatgacaaggctgattgagcatgttcatcttgactccatggtggaaatttagaggtcatatcagtgttggctgctttttctattgtgtcacattttgttattaagtatagaaaattgtagtttatacctaagggttttacctctgtattctaatgtgttatatcttgttgactcattcattgataattgcaataaagatttgtgtgggattatttctaccaatttatataa

SEQ ID NO: 1019 - protein, 207 aa, Glycine max
MGTVEAANKDANGSLLEKNPSVVFVLGGPGSGKGTQCANIVQNFGYTHLSAGDLLRAEIKSGSENGTMIQNMIKEGKIVPSEVTIKLLQKAMQESGNDKFLIDGFPRNEENRAAFEKVTGIEPAFVLFFDCPEEEMERRLLSRNQGREDDNIETIRKRFKVFLESSLPVINYYDAKGKVRKIDAARPIEEVFETVKGIFGPKNDKAD

SEQ ID NO: 1020 - DNA, 997 bp, Brassica napus
  CDS (42)..(671)
ccgtcttcagttaacatttgaacgagttgcttaatagtaccatgggatccattgctgatgctgcaaacaaggaggttaatggaaccgcaagtgagaagagacccgctgttatttttgtccttggtggtccaggaagtgggaaaggtacacagtgtgcctatattgttgaccattttggttacacacatctgagtgctggagaccttctcagggctgaaattaaatcaggttctgaaaatgggactatgatccagaatatgattaaagaagggaagattgtaccttctgaggttacaatcaagcttcttcagaaagcaattcaggagaacgggaacgacaagttcctcattgatggcttccctcgcaatgaggagaaccgagcagcctttgaaaaagttactgggattgaacctaagtttgtcttgttctttgattgtcctgaggaagagatggagagacgcttattaggacgtaaccaggggagagaggatgacaatattgagactataaggaagcgtttcaaggtgtttcttgagtctagcttaccagtgattcagtactatgaagctaaggggaaagttaggaagattcatgccgcaaagcccattgatgatgtatttcaggaggtgaaggcagtgttttctcctgaagctgagaaggttgcagcttaggcagcagcagcagtaaagagatttccagattaattgatctcaggttgctgggcagtggcatctttactaggaagtccatgcttggccgtatttttttcttctatataaccatatgattactgttattattgtaatgtaatacacattctacccttttttttgtgctacttaatacatattctacctacaatattatataatttttgtttttgttttggtatttggtgggatttgtgagattggctttctgtaataatttcattaaaattttgaattcatgggattttataatatactagattaatttctaaaaaaaaaaaaaaaaa

SEQ ID NO: 1021 - protein, 209 aa, Brassica napus
MGSIADAANKEVNGTASEKRPAVIFVLGGPGSGKGTQCAYIVDHFGYTHLSAGDLLRAEIKSGSENGTMIQNMIKEGKIVPSEVTIKLLQKAIQENGNDKFLIDGFPRNEENRAAFEKVTGIEPKFVLFFDCPEEEMERRLLGRNQGREDDNIETIRKRFKVFLESSLPVIQYYEAKGKVRKIHAAKPIDDVFQEVKAVFSPEAEKVAA

SEQ ID NO: 1022 - DNA, 870 bp, Zea mays
  CDS (1)..(867)
atggcggggatgtctcgcgcgatccgcaacttcgccgccgcgtcccggcgaaccctgaccgctgcttcggggccggcgctgccgaaggaggcggcggcggcgggggcgcgggtgagggcggcggcgcccgggcgcagggggcgggatcaggaggacgggaggcgcgtgcagtgggtgttcctcgggtgccccggggtggggaagggcacctacgccagccgcctctcgcagctgctcggcgtcccgcacatcgccaccggcgacctcgtccgcgacgccctggccacccctggccccttctccaacaagcttgctgagattgtcaatcatggaaaactggtgtctgatgagatcatcataaatctgctgtcaagacgtctggaagagggagaggaaaagggtgaattggggttcatccttgatggctttcctcgaaccataggacaagcggagatacttgaaggagtcacagacattgatttggtgatcaatctcaaactccgagaagaagctctgcttgcgaaatgccttggcaggaggatgtgcagccagtgtggagggaacttcaatgtggcctccattgatattgagggtgaagacggcgggcctcgaatgtacatgcccccactgttgcctcctccacagtgtgaatcgaagctgattgctagagcagacgatactgaagaagtggtaaaagagcggctgcgtgtgtaccatgatttgactgaaccagtggaggagttctacagagcacgtgggaaactgctggagttcaatctgcctggtgggatacccgaatcatggccgaagttactgcaggccctgaacatagaagaccccgacaataagcgatctgcagcagcatgattc

SEQ ID NO: 1023 - protein, 288 aa, Zea mays
MAGMSRAIRNFAAASRRTLTAASGPALPKEAAAAGARVRAAAPGRRGRDQEDGRRVQWVFLGCPGVGKGTYASRLSQLLGVPHIATGDLVRDALATPGPFSNKLAEIVNHGKLVSDEIIINLLSRRLEEGEEKGELGFILDGFPRTIGQAEILEGVTDIDLVINLKLREEALLAKCLGRRMCSQCGGNFNVASIDIEGEDGGPRMYMPPLLPPPQCESKLIARADDTEEVVKERLRVYHDLTEPVEEFYRARGKLLEFNLPGGIPESWPKLLQALNIEDPDNKRSAAA

SEQ ID NO: 1024 - DNA, 1163 bp, Zea mays
  CDS (82)..(807)
ggttccagctgcagtccagagttggaacccaagcgcacgcagcaccgtcgtcgaactcttcccttttcggcggcattggagatggcggcgaatctagaggacgtgccgtctctggatctgatgcacgaactgctccgtcggatgaagtgcagctccaagcccgacaagcacctcatcctcatcggcccacctggctctggaaagggtactcagtctccccttattaaggatgaatattgcctgtgccatttagccactggtgatatgttgagggctgctgtggcagccaagacaactctaggtatcaaagctaaagaagctatggataagggagagcttgtttcagataacttggttgtggggattattgatgaagctatgaagaaaccgtcatgccagaaaggtttcattcttgatggcttccctagaactgtcactcaagcacagaagcttgatgagatgttggcaaagcaaggtgctaatgttgacaaggtcctaaactttgcaattgatgatgctatattggaagaacggattactggccgttggatccacccacccagtggtaggacttaccatacaaaatttgcacctccaaagtctccaggagttgatgatgtaactggagagccattgattcaaaggagggatgacactgccgaggttttgaagtcaaggcttgaagccttccacaaacaaactgagcctgtgattgattattactctaagaagggcttggtggtaaatctgcctgcggagaaaccaccaaaggaagtgactgctgaggtgctgaaagccctctcatgatgaaatgcccctttgtctgagtttattcaggttaagcataatatgtaccgaaatccctttgtttgggtttcttcacaccagcatcatgcagtttcctttttgtgcgattacaccattttgtcatagctttgacaagcttggtaactgtctgaataatctgttttgaatgagggaagtttgtttttcagtaccaatactgagatgattacagcaattcatgtttgggaaattttccttaaaaaaaaaaaaaaaaaaaaaaaaaaaaaaaaaaaaaaaaaaaaaaaaaaaaaaaaaaaagaaagaaaaaaaaaaaaaaaaaaaaacctcgggggggggcccggaacccatttccccct

SEQ ID NO: 1025 - protein, 241 aa, Zea mays
MAANLEDVPSLDLMHELLRRMKCSSKPDKHLILIGPPGSGKGTQSPLIKDEYCLCHLATGDMLRAAVAAKTTLGIKAKEAMDKGELVSDNLVVGIIDEAMKKPSCQKGFILDGFPRTVTQAQKLDEMLAKQGANVDKVLNFAIDDAILEERITGRWIHPPSGRTYHTKFAPPKSPGVDDVTGEPLIQRRDDTAEVLKSRLEAFHKQTEPVIDYYSKKGLVVNLPAEKPPKEVTAEVLKALS

SEQ ID NO: 1026 - DNA, 1192 bp, Zea mays
  CDS (106)..(831)
ggagtcagaactcggaaccacttgctgcaggctgcagctgcaagcatctgcacctgcattctgcaagcctcgtctggagctcttcccgttgcattggcggcggagatggcggcgaatctggaggacgtgccgtcgctggatctgatgcacgagttgctccgccgcatgaagtgcagctccaagcccgacaagcgcctcatcgtcatcggcccacctggctctggaaagggaacccagtctcccattattaaggatgaatattgcttgtgccatttagccactggtgatatgctgagggctgctgtggcggccaagacacctctaggtatcaaggcaaaagaagctatggataagggagagcttgtttcagatgacatggttgtggggattattgatgaagctatgaagaaaccttcatgccagaaaggtttcattcttgatggctttcctagaactgtcactcaagcacagaagctcgatgaaatgttggcaaagcaaggtgctaatgttgacaaggtcctaaacttcgcaattgatgatgctatattggaagaacggattactggtcgttggatccacccacccagtggtaggacttaccatacaaaatttgcacctccaaagtctccaggagttgataatgtaactggagagccattgattcaaaggagggatgacactgccgaggttttgaagtcaaggcttaaacccttccacaaacaaaatgagcctgggattgattattactctaagaagggcttggtggtaaatcggcctgcggagaaaccaccaaaggaagtgactgctaaggtgttgaaagccctttcatgatgaaatgcccctttttttgagtttattcaggttaagcatgatatgtaccgaaatccctttgtttgggttttttccccccagcatcaggcagtttcctttttgtgcgctaaccccattttatcatagctttgacaagctcggtaactgtatgaataatctgttttgaataaaaaaagttgttttccagtaccaaaactgagaggattacaccaattcacgtttgggaaattttccttaaaaaaaaaaaaaaaaagccccccccaaaaaaaaaaaaaaaaaaaaaaaaaacgaaaaaaaaaaaaaaaattcctgcggccgcaagcttattcccattagtgaggtgttaattaaagaaaggcgt

SEQ ID NO: 1027 - protein, 241 aa, Zea mays
MAANLEDVPSLDLMHELLRRMKCSSKPDKRLIVIGPPGSGKGTQSPIIKDEYCLCHLATGDMLRAAVAAKTPLGIKAKEAMDKGELVSDDMVVGIIDEAMKKPSCQKGFILDGFPRTVTQAQKLDEMLAKQGANVDKVLNFAIDDAILEERITGRWIHPPSGRTYHTKFAPPKSPGVDNVTGEPLIQRRDDTAEVLKSRLKPFHKQNEPGIDYYSKKGLVVNRPAEKPPKEVTAKVLKALS

SEQ ID NO: 1028 - DNA, 1368 bp, Zea mays
  CDS (89)..(961)
gaattccattgcgttggggcgacgggaacggccagggccgaaccctaaaaccatcgccctgcccccgtctccgcctccgctgcatcccatggcggctgtgcagcgcctcctccgggcagtcgcccccggtggctcggcagcggcggcggtcaggaggcgcatgacgtcgcttgcgccggagcaggcgccgtctgcagccgccgggttcccattcgcggcggagcagagggcaaggcggccggtggcggcggagaggaacgtgcagtgggtgttcctgggctgccccggcgtgggcaagggcacctacgcgagccgcctgtcgcgcctcctcggcgtgccgcacatcgcgacgggggatcttgttcgcgacgagctcacctccaccgggccacttgctacgcagcttgctgaaattgttaatcaggggaaattagtttctgatgaaattatcatcaatcttttgtccaaaaggcttaagaaaggagaagaccagggagaatcaggatttattcttgatggttttccccgtacagtaaaacaagcggaaattcttgatggtgttacagacattgatatggtggttaatctgaaactaagagaagatgttatagtagagaagtgccttggcagaaggatttgcggccaatgtggaaagaacttcaatttggcctgcattgatgttaagggtgaaaatggactcccaccaatctacatggcaccactgttgcccccaaacaactgcatgtcgaagcttattacccgagctgatgataccgaagaggtggtcagaaatcggcttcagatatataatgacatgagtcaacctgtggaaggtttctaccgagagcaggggaagctcttggaatttgacttgcctggtgggatccctgaatcttggccaaagctgctccaggttctaaacctcgaggaccaagaggagttgaggttggctgcagcgtaggtctctgggagaccgacctacatactgggaaaaaagaccataccacattttttttaataatggagaagaggaaacttactccatagtttagtgcgttatgcagaagtaatggttttcttgtcaaaaagcgatttgttggtttccaccggcgttttgatggtgagccggtactatgtaacttacgatagctgtaagcactaagcaacccattcttgcttgggacacagtttggagcgcatgaagacatgctgtagtgtttttttttaattcataacaaacttgtagtacacatttgtgttcatgataaaacactgaagtagtatgatactacagaacaacacagacctgatgaatgcctatatgtgtagtacacatatgtgtgttcatgatgaaaaaaaaaaaaaaaa

SEQ ID NO: 1029 - protein, 290 aa, Zea mays
MAAVQRLLRAVAPGGSAAAAVRRRMTSLAPEQAPSAAAGFPFAAEQRARRPVAAERNVQWVFLGCPGVGKGTYASRLSRLLGVPHIATGDLVRDELTSTGPLATQLAEIVNQGKLVSDEIIINLLSKRLKKGEDQGESGFILDGFPRTVKQAEILDGVTDIDMVVNLKLREDVIVEKCLGRRICGQCGKNFNLACIDVKGENGLPPIYMAPLLPPNNCMSKLITRADDTEEVVRNRLQIYNDMSQPVEGFYREQGKLLEFDLPGGIPESWPKLLQVLNLEDQEELRLAAA

SEQ ID NO: 1030 - DNA, 1278 bp, Zea mays
  CDS (126)..(863)
ctcgaggccggccggggggaaagaagagaacaaaaataaagcaagaggcgagaggagagagcaacgacgccatcggagggaggaaagagaagaagacgatccgctagcgtgtgcgtggcgacgagatgtggcggaggcgagtgggcgccctccttctccgatctccacgaacttcttcctcggcctcctcggcctgccagagccgccgccaccatcttctccccagcgaggaacctcttgctctcaaccgtcttgccaggctcttcacgtcccaggctggaagtgatggtggcgatacccagaagccctttattgcttttgtcttaggtggtcctgggagtggcaaaggaacacagtgcactaagattgcttcggattttggatttgcccatctgagcgctggtgatattctccgacatgaaatagcatctggcagtgagaaaggggagttgatcctagaaatcataaaggaagggaggattgttccgtctgagataactgtggaactcatcagaaaagcgatggaaatgaacaatgctaaaagggttcttattgatggcttcccaaggtgtgaggaaaacagaatcgccttcgaaaggattgttggaacagaaccagacattgtgattttctttgactgtcctgaggatgagatggttaaacgccttctaggccgtaaccaggggagagttgatgataacattgagacaatcaagaagcgtctaaaagtgtttgaaagtttgaacattcctgtcgttgactactactcttcaaggggaaaagttcacaagataaatgccacgggcactgcagatgaaatatttgaagcagtccgtaggctgttttcttccttaaggttatgacgaggctagggtcttccagggaaccttgggatttgtctcttccacgcgcatggattttcggaaaagctactacgcatttcgatcagcatccacggagtttattatgtatggatgtatgtgttccctcagcacattgacatcttgtatatatgcccaaaaatgaatgtgaaccatgtggagtgtttctgaaaaaaaaggagctgaaccctggttggttgttgtagcagagactacatgtgcatctcctgtgtttgacatgcaatgagtgtgagcctagtctgtgccatggcgtatcgtgtctggccgggcctgttcgattgcttaagaaaccacaaaaaaagaaagctttacaggcagggcaggtagtagcctgctaatttttaagggcttgcttggttcccgggcggccgctcga

SEQ ID NO: 1031 - protein, 245 aa, Zea mays
MWRRRVGALLLRSPRTSSSASSACQSRRHHLLPSEEPLALNRLARLFTSQAGSDGGDTQKPFIAFVLGGPGSGKGTQCTKIASDFGFAHLSAGDILRHEIASGSEKGELILEIIKEGRIVPSEITVELIRKAMEMNNAKRVLIDGFPRCEENRIAFERIVGTEPDIVIFFDCPEDEMVKRLLGRNQGRVDDNIETIKKRLKVFESLNIPVVDYYSSRGKVHKINATGTADEIFEAVRRLFSSLRL

SEQ ID NO: 1032 - DNA, 1456 bp, Zea mays
  CDS (71)..(937)
ccggggtccaaaactgtctcttccacgtccttccgggtcctatcgctcctctccgtcgccggtggagctcatggcatcctccatggccgccgccgccaccgccaccgccctcccgctgccgtccgggacgacgcagaggccgtctgcccagggccgcctcctcttcaccgccgcacccgcccgctcccgctgccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcggaaatcgctgctggctctgagaatgggaagcgggccaaggaattcatggagaagggccagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgtcaaagtgcaaggagatgccacagtcgatgctgtctttgctaagatcgacgagctgctgggttctatcctggagaagaaaaatgaaatggtgtccagcacatgagcaaggtaaaaatgattgggtgcagtgcagatccgacaagttcatgtaatgcaagtcacctctcatgataggaacttctccaggggaatatatctgaaacacaggacgacacgtacaagtaatgtaagccagtctcacataatggaaacttctccatgtggatgtggtcaaagcataggaatttttttcctccaattattaactgtacgcgaatggaagcaacagatcattcgtaggttgtgagggcttcagagatcatctgctgctgtacatgttttgttgctgtcttgtgaacatacatgtcttgttgtttctcaactggaggaatgctgttaacctgctgtatcatttccttaaaggggcttatgtgaaaaagggaggaggacctgagcagcagctcttgcaatctttgtctaaattccttcgggatggtaaaggccatttcgcctgttctcccaaaagtatattgactgaattttccaaagaattgatcctctgtaaaaaaaaaaaaaaaaaaaa

SEQ ID NO: 1033 - protein, 288 aa, Zea mays
MASSMAAAATATALPLPSGTTQRPSAQGRLLFTAAPARSRCRSLRLRPAGRRSARSSPRATKAVVAALADPLKVMISGAPASGKGTQCELIKTKYQLAHISAGDLLRAEIAAGSENGKRAKEFMEKGQLVPDEIVVNMVKERLRQPDAQENGWLLDGYPRSYSQAMALETLEIRPDTFILLDVPDELLVERVVGRRLDPVTGKIYHLKYSPPENEEIASRLTQRFDDTEEKVKLRLETYYQNIESLLSTYENIIVKVQGDATVDAVFAKIDELLGSILEKKNEMVSST

SEQ ID NO: 1034 - DNA, 2346 bp, Zea mays
  CDS (35)..(1834)
aggtccatcgctcctcctctccgtcaccgagaaaatgtcggtctcctccccggccatggcctcgccccctctcgccgcgcccggcactcaccgcggcccctgcttctcgaccctctgccgcttaccgtcgccttcctgctacccgcctctttcggcttcctcctcaccggctatctccaccgtctccgcattcgctgtcctcaaacacaagcccagaggtctgggactaaggtgccaggccgcggaggaggcaccaccgccggcgcggggtaagacttcgctcaaggtgatgatttcgggagctcccgcctcgggaaaaggaacgcaatgccgcatgatcgtcgagaagtatggtttagttcacatatcaactggtgatcttctgcgagctgaagtatcttctggcacagaaattggcaagaaagcaaaagaatacatggacaatggaaagcttgtgccggaccaagttgtgacagatatggtggtatcacgactgtcacaaccggatatacaagaaagagggtggcttcttgatggttacccaaggagcttcagtcaagcacaacaccttgaaaatttgaaaataagaccgaatatattcattgtgctagaagttcctgatgatgttctaatcgacagatgtgttggaagacggctggatcctgtgactggcaagatttaccatttaaaaaactaccccccggagaatgaggagatttctgcccgacttattacacgttctgatgacacatttgagaaggttaaatcacgtcttgatacgtacaagcaaaattctgaagctattcttcctacatactctgatttgcttaataagattgatggaaactgcccagccgaagttgtttttcaggcgatagatttcctgttacagaagatctgtgagaacacttcagcgagcaagttgaccaaaacaaatggaaaaccaccagattctgcggatacaggttcaaaaaatgagtggcgtggaattccaacgaggttgaataacattccacattctagggaaattagggaatacttctacaacgacgtgttaaaagctacaaaacttgctattgaagataaaaagactcggttgcagatagatatcaatattcctgaacttaaccctgaaatggatgtttaccgcataggaaccctcatggaacttgtaagagaactttctctatcctttgcagatgatgggaaacgtgtcaaggtctgtgttcaaggctccatggggcaaggtgcatttgctggcatcccacttcaactggcaggaaccagaaaaattttggaattcatggactggggtgactatggggcgaagggcaccttcattaatattggagcagtaggtgctagagatgttgacaaagaagatgatatgtttgtcctcattgctccacaaaatgctgttggaaactgcataattgatgatatgagagctatgactgatgctgctggtgatagacctgtgattcttgtaaatcctcgcctaaaggatatgcctgcatcaagtggtgttatgcaaacaatgggaagggatattaggctgaagtatgctgcatcatttgagacatgctattcattccgtcttctctactacgctggttcattctatcctattatgggagctttaaggatggcttatccaaataaatatgagatttatcgaagggttgacactctcaatggaaaagagaactatattcttatagctgaattcacgaacaagccaactcctgatgagatcaccagtgctttcaaaggacaaaaaagggaagaaaaggcatcttctggattctggggtttcttaagtggtttattttaagtcaagcgatctgctgtacggcgatgcaatcctccttgtatatttttatctgataatggatgtaatatggttcggaaaatatccgttcggatcaggattcgaagatggtgaacactggttcagatggaattttcggatatccggacttttttcggataacggatacgaatacgaatattttgttcggatatcgaattcgaatacaatatgtctgatattcgtcggatatcgaatatctggatattttctcggataaatcttctcggatatccagatatcttatctggatagctgtgtgcattttgttgattgtttgtagaaagaaattaataatacacaaatagcctcaaaaattcatgaaaatttatggaggcataccatatgtccacatataatcctccaaaatatttggaccataaaatccacaatattgtagtgtttctttcatttcactttcacttgtgtgaattacacgggaaatcactctaattatccaagttcactttatcatt

SEQ ID NO: 1035 - protein, 599 aa, Zea mays
MSVSSPAMASPPLAAPGTHRGPCFSTLCRLPSPSCYPPLSASSSPAISTVSAFAVLKHKPRGLGLRCQAAEEAPPPARGKTSLKVMISGAPASGKGTQCRMIVEKYGLVHISTGDLLRAEVSSGTEIGKKAKEYMDNGKLVPDQVVTDMVVSRLSQPDIQERGWLLDGYPRSFSQAQHLENLKIRPNIFIVLEVPDDVLIDRCVGRRLDPVTGKIYHLKNYPPENEEISARLITRSDDTFEKVKSRLDTYKQNSEAILPTYSDLLNKIDGNCPAEVVFQAIDFLLQKICENTSASKLTKTNGKPPDSADTGSKNEWRGIPTRLNNIPHSREIREYFYNDVLKATKLAIEDKKTRLQIDINIPELNPEMDVYRIGTLMELVRELSLSFADDGKRVKVCVQGSMGQGAFAGIPLQLAGTRKILEFMDWGDYGAKGTFINIGAVGARDVDKEDDMFVLIAPQNAVGNCIIDDMRAMTDAAGDRPVILVNPRLKDMPASSGVMQTMGRDIRLKYAASFETCYSFRLLYYAGSFYPIMGALRMAYPNKYEIYRRVDTLNGKENYILIAEFTNKPTPDEITSAFKGQKREEKASSGFWGFLSGLF

SEQ ID NO: 1036 - DNA, 990 bp, Zea mays
  CDS (55)..(780)
cccaagcgcacgcagcaccgtcgtcgaactcttcccttttcggcggcattggagatggcggcgaatctagaggacgtgccgtctctggatctgatgcacgaactgctccgtcggatgaagtgcagctccaagcccgacaagcacctcatcctcatcggcccacctggctctggaaagggtactcagtctccccttattaaggatgaatattgcctgtgccatttagccactggtgatatgttgagggctgctgtggcagccaagacaactctaggtatcaaagctaaagaagctatggataagggagagcttgtttcagataacttggttgtggggattattgatgaagctatgaagaaaccgtcatgccagaaaggtttcattcttgatggcttccctagaactgtcactcaagcacagaagcttgatgagatgttggtaaagcaaggtgctaatgttgacaaggtcctaaactttgcaattgatgatgctatattggaagaacggattactggccgttggatccacccacccagtggtaggacttaccatacaaaatttgcacctccaaagtctccaggagttgatgatgtaactggagagccattgattcaaaggagggatgacactgccgaggttttgaagtcaaggcttgaagccttccacaaacaaactgagcctgtgattgattattactctaagaagggcttggtggtaaatctgcctgcggagaaaccaccaaaggaagtgactgctgaggtgctgaaagccctctcatgatgaaatgcccctttgtctgagtttattcaggttaagcataatatgtactgaaatccctttgtttgggtttcttcacaccagcatcatgcagtttcctttttgtgcgattacaccattttgtcatagctttgacaagcttggtaactgtctgaataatctgttttgaatgagggaagttgtttttcagtaccaaaaaaaaaaaaaaaaaaa

SEQ ID NO: 1037 - protein, 241 aa, Zea mays
MAANLEDVPSLDLMHELLRRMKCSSKPDKHLILIGPPGSGKGTQSPLIKDEYCLCHLATGDMLRAAVAAKTTLGIKAKEAMDKGELVSDNLVVGIIDEAMKKPSCQKGFILDGFPRTVTQAQKLDEMLVKQGANVDKVLNFAIDDAILEERITGRWIHPPSGRTYHTKFAPPKSPGVDDVTGEPLIQRRDDTAEVLKSRLEAFHKQTEPVIDYYSKKGLVVNLPAEKPPKEVTAEVLKALS

SEQ ID NO: 1038 - DNA, 1313 bp, Zea mays
  CDS (186)..(911)
aaaaacaactcacacacccaatttttaaaaatccgcgaagaaaagaccaagcaaaccgcccggacccagccgatcgagggagagtcagaactcggaaccacttgctgcaggctgcagctgcaagcatctgcacctgcattctgcaagcctcgtctggagctcttcccgttgcattggcggcggagatggcggcgaatctggaggacgtgccgtcgctggatctgatgcacgagttgctccgccgcatgaagtgcagctccaagcccgacaagcgcctcatcgtcatcggcccacctggctctggaaagggaacccagtctcccattattaaggatgaatattgcttgtgccatttagccactggtgatatgctgagggctgctgtggcggccaagacacctctaggtatcaaggcaaaagaagctatggataagggagagcttgtttcagatgacatggttgtggggattattgatgaagctatgaagaaaccttcatgccagaaaggtttcattcttgatggctttcctagaactgtcactcaagcacagaagctcgatgaaatgttggcaaagcaaggtgctaatgttgacaaggtcctgaacttcgcaattgatgatgctatattggaagaacggattactggtcgttggatccattcggccagtggtaggacttaccattcaaaatttgcacctccaaagtctccgggagttgatgatgtaactggagagccattgattcaacgaagagatgacacagctgagatcttgaagtcaaggcttgaagccttccacagacaaactgaacctgtgattgagtattactccaagagaggcttagtggtgaacctgcccgcagagaaaccaccaaaggaagtgactgctgaggttttgaaagccctctcttgatgaagtgtccactcttcagtttcagcatgacatcgaccaaaaatcccattgccccagtttcttcaaaatttatacttaggccaacaacatggggtttttattttcggtatgctttttgtgtgaattcaccattttatcacagctttgacagagctcgggaactgtctggataatctatgttttgaatgagagaagtttttcagtaacaatactgatatgattacaacaattcacctttggaaaattttcttggcaaactttgttccatttcttacatcaatgctatgttacttctggctatggtattcatgaagatacctaaggtattctgttcgctcatccccatgctctgttgagcggagatactgatgtgctgcaatgtcaaataaacgtttggtgttg

SEQ ID NO: 1039 - protein, 241 aa, Zea mays
MAANLEDVPSLDLMHELLRRMKCSSKPDKRLIVIGPPGSGKGTQSPIIKDEYCLCHLATGDMLRAAVAAKTPLGIKAKEAMDKGELVSDDMVVGIIDEAMKKPSCQKGFILDGFPRTVTQAQKLDEMLAKQGANVDKVLNFAIDDAILEERITGRWIHSASGRTYHSKFAPPKSPGVDDVTGEPLIQRRDDTAEILKSRLEAFHRQTEPVIEYYSKRGLVVNLPAEKPPKEVTAEVLKALS

SEQ ID NO: 1040 - DNA, 1127 bp, Zea mays
  CDS (73)..(807)
ggagagagcaacgacgccatcggagggaggaaagagaagaagacgatccgctagcgtgtgcgtggcgacgagatgtggcggaggcgagtgggcgccctcctccgatctccacgaacttcttcctcggcctcctcggcctgccagagccgccgccaccatcttctccccagcgaggaacctcttgctctcaaccgtcttgccaggctcttcacgtcccaggctggaagtgatggtggcgatacccagaagccctttattgcttttgtcttaggtggtcctgggagtggcaaaggaacacagtgcactaagattgcttcggattttggatttgcccatctgagcgctggtgatattctccgacatgaaatagcatctggcagtgagaaaggggagttgatcctagaaatcataaaggaagggaggattgttccgtctgagataactgtggaactcatcagaaaagcgatggaaatgaacaatgctaaaagggttcttattgatggcttcccaaggtgtgaggaaaacagaatcgccttcgaaaggattgttggaacagaaccagacattgtgattttctttgactgtcctgaggatgagatggttaaacgccttctaggccgtaaccaggggagagttgatgataacattgagacaatcaagaagcgtctaaaagtgtttgaaagtttgaacattcctgtcgttgactactactcttcaaggggaaaagttcacaagataaatgccacgggcactgcagatgaaatatttgaagcagtccgtaggctgttttcttccttaaggttatgacgaggctagggtcttccagggaaccttgggatttgtctcttccacgcgcatggattttcggaaaagctactacgcatttcgatcagcatccacggagtttattatgtatggatgtatgtgttccctcagcacattgacatcttgtatatatgcccaaaaatgaatgtgaaccatgtggagtgtttctgaaaaaaaaggagctgaaccctggttggttgttgtagcagagactacatgtgcatctcttgtgtttgacatgcaatgagtgtgagcctagtgtgtgccgtggcgtatcgtgtctggaaaaaaaaaaaaaaaaa

SEQ ID NO: 1041 - protein, 244 aa, Zea mays
MWRRRVGALLRSPRTSSSASSACQSRRHHLLPSEEPLALNRLARLFTSQAGSDGGDTQKPFIAFVLGGPGSGKGTQCTKIASDFGFAHLSAGDILRHEIASGSEKGELILEIIKEGRIVPSEITVELIRKAMEMNNAKRVLIDGFPRCEENRIAFERIVGTEPDIVIFFDCPEDEMVKRLLGRNQGRVDDNIETIKKRLKVFESLNIPVVDYYSSRGKVHKINATGTADEIFEAVRRLFSSLRL

SEQ ID NO: 1042 - DNA, 1281 bp, Zea mays
  CDS (98)..(970)
cgcctccgcacatacaaatacacgacgggaacggccagggacgaaccctaaaaccatcgccctgcccccgcctccgtctccgcctccgctgcatcccatggcggctgtgcagcgcctcctccgggcagtcgcccccggtggctcggcagcggcggcggtcaggaggcgcatgacgtcgcttgcgccggagcaggcgccgtctgcagccgccgggttcccattcgcggcggagcagagagcaaggcggccggtggcggcggagaggaacgtgcagtgggtgttcctgggctgccccggcgtgggcaagggcacctacgcgagccgcctgtcgcgcctcctcggcgtgccgcacatcgcgacgggggatcttgttcgcgacgagctcgcctccaccgggccacttgctacgcagcttgctgaaattgttaatcaggggaaattagtttctgatgaaattatcatcaatcttttgtccaaaaggcttaagaaaggagaagaccagggagaatcaggatttattcttgatggttttccccgtacagtaaaacaagcggaaattcttgatggcgttacagacattgatatggtggttaatctgaaactaagagaagatgttatagtagagaagtgccttggcagaaggatttgcggccaatgtggaaagaacttcaatttggcctgcattgatgttaagggtgaaaatggactcccaccaatctacatggcaccactgttgcccccaaacaactgcatgtcgaagcttattacccgagctgatgataccgaagaggtggtcagaaatcggcttcagatatataatgacatgagtcaacctgtggaaggtttctaccgagagcaggggaagctcttggaatttgacttgcctggtgggatccctgaatcttggccaaagctgctccaggttctaaacctcgaggaccaagaggagttgaggttggctgcagcgtagccgcgtaggtctctgggagaccgacctacatactgggaaaaagaccataccacattttttttgaataatggagaagaggaaacttactccatagtttagtgcgttatgcagaagtaatggttttcttgtaaaaatcgatttgttggtttccaccggcgttttgatgatgagccggtactatgtaacttacgatagctgtaagcactaagcagcccattcttgcttgggacacagtttggagcgcatgaagacaaaaaaaaaaaaaaaaaagcgtctctctctctctctctctctctctctctctctctctc

SEQ ID NO: 1043 - protein, 290 aa, Zea mays
MAAVQRLLRAVAPGGSAAAAVRRRMTSLAPEQAPSAAAGFPFAAEQRARRPVAAERNVQWVFLGCPGVGKGTYASRLSRLLGVPHIATGDLVRDELASTGPLATQLAEIVNQGKLVSDEIIINLLSKRLKKGEDQGESGFILDGFPRTVKQAEILDGVTDIDMVVNLKLREDVIVEKCLGRRICGQCGKNFNLACIDVKGENGLPPIYMAPLLPPNNCMSKLITRADDTEEVVRNRLQIYNDMSQPVEGFYREQGKLLEFDLPGGIPESWPKLLQVLNLEDQEELRLAAA

SEQ ID NO: 1044 - DNA, 1081 bp, Zea mays
  CDS (112)..(750)
cgcacgcacccagcgatcagcgcagattccttccacgccccccctcctttccaggtcccctcgcccgcgctctcagatctcgcgcgcctcccacaagggaaaccttgagccatgggcacagttgtggatgccgctccagcagttgtggctgaggtcactgagaacatgttgggtggcaagaaagttacagttgtatttgtcctaggtggtcctggaagtggaaaaggcacacagtgtgccaacatcgtggagcactttggattcacccatcttagtgctggagatcttctgcgtgcagagattaaatctggctctgagaacggaaccatgattgagaacatgataaaggagggaaagattgttccatcggaggtgactataaagcttttgcaggaggcaatgataaaaagtgaaaatgacaaattcctgatcgatggatttccaaggaatgaggagaatcgtgcagcctttgagaatgttaccaaaatttctcctgcatttgtgctattctttgactgttctgaagaagatatggagaaacgactcctggggcgcaatcagggaagggttgatgataacattgaaactatcaaaaaaaggttcaaaacctttgttgactcaactctgcctgtcattgagcattacaactcaaaggacaaggttaaaaagattgatgctgcaaaaccaatccccgaggtgtttgaagacgtcaaagccatttttgccccatattctctaaaggctgaatagagcaatctaagggacatgataaaggtgatacatggtgtctaggcaccacataaacatatctgtgattatgatggaccctttaatatagaacaaaagttttggctcatttgagctaccagcgtaccagtaggcaattcgatttgttaccagcaacaagtgatctgattcccagtggtcctgctagagtaacattttttaccactgtctgttgtctatgtatcctttgatattgtgttgtaccaatgtgcaatttactctatggactgatggaacattgtgccatcccatccaccagatttattgtggcgttatggaaaaaaaaaaaaaaaaa

SEQ ID NO: 1045 - protein, 212 aa, Zea mays
MGTVVDAAPAVVAEVTENMLGGKKVTVVFVLGGPGSGKGTQCANIVEHFGFTHLSAGDLLRAEIKSGSENGTMIENMIKEGKIVPSEVTIKLLQEAMIKSENDKFLIDGFPRNEENRAAFENVTKISPAFVLFFDCSEEDMEKRLLGRNQGRVDDNIETIKKRFKTFVDSTLPVIEHYNSKDKVKKIDAAKPIPEVFEDVKAIFAPYSLKAE

SEQ ID NO: 1046 - DNA, 1133 bp, Zea mays
  CDS (80)..(805)
gagaatacccggaaggccggaacccacctgctgcgcacctgcaagcctcgagtggagctcttccacggccgcggtggagatggcggcgaatctggaggacgtgccgtcactggatctgatgcacgagctgctccgccgcatgaagtgcagctccaagcccgacaagcgcctcatcctcatcggtccacctggctctggaaagggaactcagtctcctattatcaaggatgaatattgcttgtgccatttagccactggtgacatgctgagggctgctgtggcggccaagacacctctaggtatcaaagctaaagaagctatgaataagggagagcttgtttcagatgatttggttgtgggcattattgatgaagctatgaagaaaccctcatgccagaaaggtttcattcttgatggctttcctagaactgtgactcaagcacagaagcttgatgagatgttggcaaagcaaggtgccaatgttgacaaagtcctgaactttgcaattgatgatgctgtattggaagaacggattactggtcgttggatccactcagccagtggtaggacttaccactcaaaatttgcacctccaaagtctccaggagttgatgatgtaactggagagccattgattcaaaggagagatgacaccgctgaggtcttgaagtcaaggcttgaagctttccacagacaaaccgaacctgtgattgattattactccaagaagggcttagtggtgaacctgcctgcagagaaaccaccgaaggaagtgactgctgaggtgcagaaagccctctcgtgatgaaatgtccactcttgaggttaaacatgacatctaccaaaacccctttgtttgggtttcttcaaaatttgcactaggccaacatcatgaggttttttattttcagtatccttattgtgcggatgcaccattttttgttatcacacctttcacaagctcggcaattgtctgaataatttctgtgtctaatgatggaactgtttttcagtaacaaactgatatgattacaacaattcatctttgggaaaatttccctgcaaaccttgttccagttcttacaagactgctatgttactggctataataatcaggaagataccttgctctg

SEQ ID NO: 1047 - protein, 241 aa, Zea mays
MAANLEDVPSLDLMHELLRRMKCSSKPDKRLILIGPPGSGKGTQSPIIKDEYCLCHLATGDMLRAAVAAKTPLGIKAKEAMNKGELVSDDLVVGIIDEAMKKPSCQKGFILDGFPRTVTQAQKLDEMLAKQGANVDKVLNFAIDDAVLEERITGRWIHSASGRTYHSKFAPPKSPGVDDVTGEPLIQRRDDTAEVLKSRLEAFHRQTEPVIDYYSKKGLVVNLPAEKPPKEVTAEVQKALS

SEQ ID NO: 1048 - DNA, 2266 bp, Zea mays
  CDS (42)..(1841)
gcacgcgaggtccatcgctcctcctctccgtcaccgagaaaatgtcggtctcctccccggccatggcctcgccccctctcgccgcgcccggcactcaccgcggcccctgcttctcgaccctctgccgcttaccgtcgccttcctgctacccgcctctttcggcttcctcctcaccggctatctccaccgtctccgcattcgctgtcctcaaacacaagcccagaggtctgggactaaggtgccaggccgcggaggaggcaccaccgccggcgcggggtaagacttcgctcaaggtgatgatttcgggagctcccgcctcgggaaaaggaacgcaatgccgcatgatcgtcgagaagtatggtttagttcacatatcaactggtgatcttctgcgagctgaagtatcttctggcacagaaattggcaagaaagcaaaagaatacatggacaatggaaagcttgtgccggaccaagttgtgacagatatggtggtatcacgactgtcacaaccggatatacaagaaagagggtggcttcttgatggttacccaaggagcttcagtcaagcacaacaccttgaaaatttgaaaataagaccgaatatattcattgtgctagaagttcctgatgatgttctaatcgacagatgtgttggaagacggctggatcctgtgactggcaagatttaccatttaaaaaactaccccccggagaatgaggagatttctgcccgacttattacacgttctgatgacacatttgagaaggttaaatcacgtcttgatacgtacaagcaaaattctgaagctattcttcctacatactctgatttgcttaataagattgatggaaactgcccagccgaagttgtttttcaggcgatagatttcctgttacagaagatctgtgagaacacttcagcgagcaagttgaccaaaacaaatggaaaacgaccagattctgcggatacaggttcaaaaaatgagtggcgtggaattccaacgaggttgaataacattccacattctagggaaattagggaatacttctacaacgacgtgttaaaagctacaaaacttgctattgaagataaaaagactcggttgcagatagatatcaatattcctgaacttaaccctgaaatggatgtttaccgcataggaaccctcatggaacttgtaagagaactttctctatcctttgcagatgatgggaaacgtgtcaaggtctgtgttcaaggctccatggggcaaggtgcatttgctggcatcccacttcaactggcaggaaccagaaaaattttggaattcatggactggggtgactatggggcgaagggcaccttcattaatattggagcagtaggtgctagagatgttgacaaagaagatgatatgtttgtcctcattgctccacaaaatgctgttggaaactgcataattgatgatatgagagctatgactgatgctgctggtgatagacctgtgattcttgtaaatcctcgcctaaaggatatgcctgcatcaagtggtgttatgcaaacaatgggaagggatattaggctgaagtatgctgcatcatttgagacatgctattcattccgtcttctctactacgctggttcattctatcctattatgggagctttaaggatggcttatccaaataaatatgagatttatcgaagggttgacactctcaatggaaaagagaactatattcttatagctgaattcacgaacaagccaactcctgatgagatcaccagtgctttcaaaggacaaaaaagggaagaaaaggcatcttctggattctggggtttcttaagtggtttattttaagtcaagcgatctgctgtacggcgatgcaatcctccttgtatatttttatctgataatggatgtaatatggttcggaaaatatccgttcggatcaggattcgaagatggtgaacactggttcagatggaattttcggatatccggacttttttcggataacggatacgaatacgaatattttgttcggatatcgaattcgaatacaatatgtctgatattcgtcggatatcgaatatctggatattttctcggataaatcttctcggatatccggatatcttatctggatagctgtgtgcattttgttgattgtttgtagaaagaaattaataatacacaaatagcctcaaaaattcatgaaaatttatggaggcataccatatgtccacatataatcctccaaaatatttggaccataaaatcca

SEQ ID NO: 1049 - protein, 599 aa, Zea mays
MSVSSPAMASPPLAAPGTHRGPCFSTLCRLPSPSCYPPLSASSSPAISTVSAFAVLKHKPRGLGLRCQAAEEAPPPARGKTSLKVMISGAPASGKGTQCRMIVEKYGLVHISTGDLLRAEVSSGTEIGKKAKEYMDNGKLVPDQVVTDMVVSRLSQPDIQERGWLLDGYPRSFSQAQHLENLKIRPNIFIVLEVPDDVLIDRCVGRRLDPVTGKIYHLKNYPPENEEISARLITRSDDTFEKVKSRLDTYKQNSEAILPTYSDLLNKIDGNCPAEVVFQAIDFLLQKICENTSASKLTKTNGKRPDSADTGSKNEWRGIPTRLNNIPHSREIREYFYNDVLKATKLAIEDKKTRLQIDINIPELNPEMDVYRIGTLMELVRELSLSFADDGKRVKVCVQGSMGQGAFAGIPLQLAGTRKILEFMDWGDYGAKGTFINIGAVGARDVDKEDDMFVLIAPQNAVGNCIIDDMRAMTDAAGDRPVILVNPRLKDMPASSGVMQTMGRDIRLKYAASFETCYSFRLLYYAGSFYPIMGALRMAYPNKYEIYRRVDTLNGKENYILIAEFTNKPTPDEITSAFKGQKREEKASSGFWGFLSGLF

SEQ ID NO: 1050 - DNA, 23 bp, Artificial sequence
  primer
atgcgtatcattctgcttggcgc

SEQ ID NO: 1051 - DNA, 24 bp, Artificial sequence
  primer
ttagccgaggattttttccagatc

SEQ ID NO: 1052 - protein, 196 aa, Artificial sequence
  consensus sequence
  Variant (2)..(2): Xaa in position 2 is any amino acid
  Variant (5)..(5): Xaa in position 5 is any amino acid
  Variant (11)..(25): Xaa in position 11 to 25 is any amino acid
  Variant (28)..(29): Xaa in position 28 to 29 is any amino acid
  Variant (31)..(39): Xaa in position 31 to 39 is any amino acid
  Variant (41)..(49): Xaa in position 41 to 49 is any amino acid
  Variant (51)..(52): Xaa in position 51 to 52 is any amino acid
  Variant (54)..(76): Xaa in position 54 to 76 is any amino acid
  Variant (77)..(79): Xaa in position 77 to 79 is any or no amino acid
  Variant (85)..(100): Xaa in position 85 to 100 is any amino acid
  Variant (101)..(105): Xaa in position 101 to 105 is any or no amino acid
  Variant (107)..(118): Xaa in position 107 to 118 is any amino acid
  Variant (120)..(121): Xaa in position 120 to 121 is any amino acid
  Variant (124)..(126): Xaa in position 124 to 126 is any amino acid
  Variant (127)..(168): Xaa in position 127 to 168 is any or no amino acid
  Variant (170)..(170): Xaa in position 170 is any amino acid
  Variant (173)..(179): Xaa in position 173 to 179 is any amino acid
  Variant (181)..(184): Xaa in position 181 to 184 is any amino acid
  Variant (185)..(190): Xaa in position 185 to 190 is any or no amino acid
  Variant (192)..(195): Xaa in position 192 to 195 is any amino acid
GXPGXGKGTQXXXXXXXXXXXXXXXGDXXRXXXXXXXXXGXXXXXXXXXGXXVXXXXXXXXXXXXXXXXXXXXXXXXXXDGFPRXXXXXXXXXXXXXXXXXXXXXVXXXXXXXXXXXXRXXGRXXXXXXXXXXXXXXXXXXXXXXXXXXXXXXXXXXXXXXXXXXXXXRXDDXXXXXXXRXXXXXXXXXXPXXXXY

SEQ ID NO: 1053 - protein, 57 aa, Artificial sequence
  protein pattern
  Variant (2)..(5): Xaa in position 2 to 5 is any amino acid
  Variant (11)..(11): Xaa in position 11 is Ala, Cys or Ser
  Variant (12)..(13): Xaa in position 12 to 13 is any amino acid
  Variant (14)..(14): Xaa in position 14 is Ile, Leu, Met or Val
  Variant (15)..(17): Xaa in position 15 to 17 is any amino acid
  Variant (18)..(18): Xaa in position 18 is Phe or Tyr
  Variant (19)..(22): Xaa in position 19 to 22 is any amino acid
  Variant (23)..(23): Xaa in position 23 is Ile, Leu or Met
  Variant (24)..(24): Xaa in position 24 is Ala, Cys or Ser
  Variant (25)..(25): Xaa in position 25 is Ala or Thr
  Variant (28)..(28): Xaa in position 28 is Ile, Leu or Met
  Variant (29)..(29): Xaa in position 29 is Phe or Leu
  Variant (31)..(31): Xaa in position 31 is any amino acid
  Variant (32)..(32): Xaa in position 32 is Ala or Glu
  Variant (33)..(33): Xaa in position 33 is Ala, Ile or Val
  Variant (34)..(36): Xaa in position 34 to 36 is any amino acid
  Variant (37)..(37): Xaa in position 37 is Ser or Thr
  Variant (38)..(38): Xaa in position 38 is Asp, Glu, Pro or Thr
  Variant (39)..(39): Xaa in position 39 is any amino acid
  Variant (41)..(42): Xaa in position 41 to 42 is any amino acid
  Variant (43)..(43): Xaa in position 43 is Ala or Ile
  Variant (44)..(46): Xaa in position 44 to 46 is any amino acid
  Variant (47)..(47): Xaa in position 47 is Ile or Met
  Variant (48)..(49): Xaa in position 48 to 49 is any amino acid
  Variant (51)..(51): Xaa in position 51 is any amino acid
  Variant (52)..(52): Xaa in position 52 is Ile or Leu
  Variant (54)..(55): Xaa in position 54 to 55 is any amino acid
  Variant (56)..(56): Xaa in position 56 is Ala, Asp, Glu, Asn, Gln or Ser
  Variant (57)..(57): Xaa in position 57 is Ile, Leu, Met or Val
GXXXXGKGTQXXXXXXXXXXXXXXXGDXXRXXXXXXXXXGXXXXXXXXXGXXVXXXX

SEQ ID NO: 1054 - protein, 20 aa, Artificial sequence
  protein pattern
  Variant (2)..(2): Xaa in position 2 is any amino acid
  Variant (3)..(5): Xaa in position 3 to 5 is any or no amino acid
  Variant (7)..(7): Xaa in position 7 is any or no amino acid
  Variant (10)..(10): Xaa in position 10 is Phe or Tyr
  Variant (13)..(13): Xaa in position 13 is Asn, Ser or Thr
  Variant (14)..(15): Xaa in position 14 to 15 is any amino acid
  Variant (16)..(16): Xaa in position 16 is Asn or Gln
  Variant (17)..(17): Xaa in position 17 is any amino acid
  Variant (18)..(18): Xaa in position 18 is Ala, Asp, Glu, Gln or Thr
  Variant (19)..(19): Xaa in position 19 is any amino acid
  Variant (20)..(20): Xaa in position 20 is Phe, Leu or Met
GXXXXLXDGXPRXXXXXXXX

SEQ ID NO: 1055 - DNA, 1053 bp, Escherichia coli
  CDS (1)..(1053)
atgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaa

SEQ ID NO: 1056 - protein, 350 aa, Escherichia coli
MNYQNDDLRIKEIKELLPPVALLEKFPATENAANTVAHARKAIHKILKGNDDRLLVVIGPCSIHDPVAAKEYATRLLALREELKDELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKEGLNKAGLPAQVMIDFSHANSSKQFKKQMDVCADVCQQIAGGEKAIIGVMVESHLVEGNQSLESGEPLAYGKSITDACIGWEDTDALLRQLANAVKARRG

SEQ ID NO: 1057 - DNA, 1092 bp, Mesorhizobium loti MAFF303099
  CDS (1)..(1092): transl_table=11
gtgttgaccaccacagacgacctccgggtcaaggaaatccgagaactgagcacgccggaccaggtgatgcgggaaatcccgcgcacgctgacggcgacgcgcaccgtgagcgcctcacgcaatgcgatccacgctattctgaacggcaccgacgaccggctgcttgtcgtcgtcggtccctgttcgatccacgatccggtcgcggccgttgactatgccagccgtctggcggcgctgcgcgagaccctgtccgaccggcttgagatcgtgatgcgggtgtatttcgagaagccgcgcaccacggtcggctggaagggcctgatcaacgatcccgaccttgacggcagcttcaacatcgacaaggggctcaggatggcacgcaacgtgctttccgccgtcaacaatctcggcctgccggcggccaccgaattcctcgacatgaccacgccgcaatacattgccgacctcgtcgcctggggtgccatcggcgcgcgcaccaccgaaagccaaatccaccgtgagctggcctcgggcctgtcctgcccggtcggtttcaagaacggcaccgacggcaatctcaggatcgccggcgaggcggtgaaatcggccgcccagccgcatcatttcatggcggtgaccaagggcggacgcagcggcatcgccaccaccaccggcaatgaggactgccatgtcatcctgcgcggcggcgttcagcccaactacgacgcggcgagcgtcgaggcggcctcggtcgaactcgcccgcatcggtgtcgcgccgcggctgatgatcgatgtcagccacgccaactccgccaagaagcctgagaaccagccgaaggtggcggccgatgtggccggccaggtggcggcgggcgacgagcgcatcatcggcctgatgatcgagagcaatctcgtcgccggccggcaggacgtggtgcccggcaagccgctcgtctatggccagagcatcaccgatggctgcatcgactgggcgaccaccgagaccgtgctgcatggccttgccggtgccgtcgagtggcgccggtcggcacgccgcgccatgctggaaagccggcagggtgctgcctga

SEQ ID NO: 1058 - protein, 363 aa, Mesorhizobium loti MAFF303099
MLTTTDDLRVKEIRELSTPDQVMREIPRTLTATRTVSASRNAIHAILNGTDDRLLVVVGPCSIHDPVAAVDYASRLAALRETLSDRLEIVMRVYFEKPRTTVGWKGLINDPDLDGSFNIDKGLRMARNVLSAVNNLGLPAATEFLDMTTPQYIADLVAWGAIGARTTESQIHRELASGLSCPVGFKNGTDGNLRIAGEAVKSAAQPHHFMAVTKGGRSGIATTTGNEDCHVILRGGVQPNYDAASVEAASVELARIGVAPRLMIDVSHANSAKKPENQPKVAADVAGQVAAGDERIIGLMIESNLVAGRQDVVPGKPLVYGQSITDGCIDWATTETVLHGLAGAVEWRRSARRAMLESRQGAA

SEQ ID NO: 1059 - DNA, 1074 bp, Vibrio cholerae O1 biovar eltor str. N16961
  CDS (1)..(1074): transl_table=11
atgaaaaaaagtgaattgagtgatgtgaatatcagtaatgaacagatattgatcaccccagatgccttaaaagccaagattccactcagtgacaaggcgcgtaagtttattcgtgagtcacgtcagacggtggcggacattatccacaaacgcgatcctcgcttgctgatcgtctgtggtccttgctcaattcatgatgtggatgcggcgaaagagtacgccaaaaaactcaaagcactctcggcgcagctgagcgaccagctctacatcgtaatgcgcgtgtactttgaaaaaccgcgtactacggtcggttggaaagggctgattaacgatccgcatcttgatggcagttttgatatcgaacacggtctgcatgttgggcgtcaactcttggtcgatttggccgaaatggaaattccactggcaaccgaagcgttggacccgattagcccgcaatacttggcggatacttttagttgggcggcgattggtgcgcgtaccacggaatcacaaactcaccgcgagatggcaagtggcctttccatgccaatcggctttaaaaatggcacggatggtaacttggcaacggcgattaatgccatgcaggccgcttcatccagtcaccgctttatgggaattaaccgcgaaggacaagtggcactgctcacgacacaaggcaacccgaatgggcatgtgattttacgtggtggcaaacagaccaactacgattcggtttctgtcgcggaatgtgaagaagagatgcaaaaagcgcgtttggaaccctctttgatggtggattgcagccatgcgaactcacgtaaagattaccgccgtcagccgttggtggcagaagatgtgattcatcaaatccgtgaaggcaatcgctcgatcattggcctgatgattgaaagccatctcaatgaaggaaatcagtcttcggatctgcctcgtgaaaagatgcaatacggagtctcgatcactgacggctgtataaattggtcaacgactgaggcattattacgtcgtgcgcatcaggaacttattccctttttgcacaatcgtttgcaaggataa

SEQ ID NO: 1060 - protein, 357 aa, Vibrio cholerae O1 biovar eltor str. N16961
MKKSELSDVNISNEQILITPDALKAKIPLSDKARKFIRESRQTVADIIHKRDPRLLIVCGPCSIHDVDAAKEYAKKLKALSAQLSDQLYIVMRVYFEKPRTTVGWKGLINDPHLDGSFDIEHGLHVGRQLLVDLAEMEIPLATEALDPISPQYLADTFSWAAIGARTTESQTHREMASGLSMPIGFKNGTDGNLATAINAMQAASSSHRFMGINREGQVALLTTQGNPNGHVILRGGKQTNYDSVSVAECEEEMQKARLEPSLMVDCSHANSRKDYRRQPLVAEDVIHQIREGNRSIIGLMIESHLNEGNQSSDLPREKMQYGVSITDGCINWSTTEALLRRAHQELIPFLHNRLQG

SEQ ID NO: 1061 - DNA, 1188 bp, Vibrio cholerae O1 biovar eltor str. N16961
  CDS (1)..(1188): transl_table=11
ttggtcaaatgctcggtttttacttcaatttacacccctttccgcagctgttttcggcgtaatggtttattctcgttgacaaattcgttatctttagcgcttcgcaataaaaggacaggcgctcctatgccactgaaaaccgatgaattaagaacccaagcattgggacctatgcctactccggcagaattaagtcacgcacatcctatcactgatgaagttgcgctacggatcgcgcagtctcgtcgccaaattgaaagcattcttaccggtgaagatgatcgcctattagtgatagtggggccttgttcggtgcatgataccgatgccgcactcgactacgctcgccgccttgctgcgctacaagaaaactatactgatgagctttttgtggtgatgcggacctatttcgaaaaaccacgtactgtggtgggttggaaaggactgatcaccgatccaaacttagatggctcttacgctttagaaaccggtctcaataaagcgcgaaagttgctgcttgatgtaaacaagctcggattggctaccgcgaccgagtttcttgatatgatcacaggccaatacatcgcggaccttatcacgtggggcgcaattggtgcgcgtaccactgagtcgcaaattcaccgtgagatggcctctgcgctctcctgccctgtgggttttaaaaatggcactaacggtaatgtgaaaatcgcgattgatgcgatccgcgcggccaaagcgtcacattacttctattcaccagataagaatggtcgtatgacggtttaccgtaccagtggtaacccatttggtcatattattctgcgtggtggtgatagcggaccaaactttgatgcggcttcgattaatgaagcttgccagcagttggcgcaattcaacttaccagagcgtttagtggtggatttcagccacgcgaactgtcaaaaacaacaccgtaaacaagtggatgtcgcgcgcgatatttgccagcaaattgaagctggcagccacaaaattgcgggcatcatggcggaaagcttccttgtggaaggcaatcagccaatgcacgatctcaataatctgacttatggtctgtcgatcaccgatccttgtttaggatggaaagataccgccaccatgcttgatatgctggctcaatcgatcaaagtccgtcgttctcgtcattaa

SEQ ID NO: 1062 - protein, 395 aa, Vibrio cholerae O1 biovar eltor str. N16961
MVKCSVFTSIYTPFRSCFRRNGLFSLTNSLSLALRNKRTGAPMPLKTDELRTQALGPMPTPAELSHAHPITDEVALRIAQSRRQIESILTGEDDRLLVIVGPCSVHDTDAALDYARRLAALQENYTDELFVVMRTYFEKPRTVVGWKGLITDPNLDGSYALETGLNKARKLLLDVNKLGLATATEFLDMITGQYIADLITWGAIGARTTESQIHREMASALSCPVGFKNGTNGNVKIAIDAIRAAKASHYFYSPDKNGRMTVYRTSGNPFGHIILRGGDSGPNFDAASINEACQQLAQFNLPERLVVDFSHANCQKQHRKQVDVARDICQQIEAGSHKIAGIMAESFLVEGNQPMHDLNNLTYGLSITDPCLGWKDTATMLDMLAQSIKVRRSRH

SEQ ID NO: 1063 - DNA, 1086 bp, Pasteurella multocida subsp. multocida str. Pm70
  CDS (1)..(1086): transl_table=11
atgacagaatataaaaatgaaatttatatcgaaaatgatgacaccagaattgataaaattgagcaagttttaccgcctgtggcgttattagaaaaatttcctgccagtgatgtggcagtagaaaccgtcagacaaacacgaaaaaaagcacataatattattcatcgaaaagatgaccgtttattagttgtcatgggaccttgttccattcatgatcctgtttctgcgctggagtatgcgaaacggattaaaatgatgcgcgaaaaataccaagatagcttggagattattatgcgtgtctattttgaaaaaccgcgaaccacggtagggtggaaaggcttgattaatgatcctcacctaaatggtacctttgagctgaatgaagggttgcgtcttgcgcgtaaattattatcggacgttaatgatttaggggtaccggctgcgggtgaatttttggacatgattacaccacaatatctggctgatttcatgagttggggtgcgattggtgccagaaccacagaatcacaggtgcaccgtgaacttgcctctggtctatcttgtgcagttggctttaaaaatggcacgaatggtggggtcagaatcgcgttagatgcgattggggcagcagaagcaccacattattttctttctgtcacgaaatttggtcattctgcgattgtatctacaaaagggaatgaagactgccacattattttacgaggcggtgataaaggtcctaattatgatgcagagcatattgctatggtttgtgcagagatcgaaaaaacagggcgtattccacatgtgatggtcgatttcagccatgctaacagttgtaaacaatttaaaaaacaattagaggtttgtgacagtgtttgccagcaaatcgctatgggttctactcaaatctttggtgtgatggtagaaagccatcttgttgaagggcgacaagatttagtagatggaaaagcggtcacttatgggcagagtatcacggacgcctgtattgggtgggaagatagcgagaaagttttggaatcgctttcaaaagctgtcatccaacgccgaaatttgcagcaataa

SEQ ID NO: 1064 - protein, 361 aa, Pasteurella multocida subsp. multocida str. Pm70
MTEYKNEIYIENDDTRIDKIEQVLPPVALLEKFPASDVAVETVRQTRKKAHNIIHRKDDRLLVVMGPCSIHDPVSALEYAKRIKMMREKYQDSLEIIMRVYFEKPRTTVGWKGLINDPHLNGTFELNEGLRLARKLLSDVNDLGVPAAGEFLDMITPQYLADFMSWGAIGARTTESQVHRELASGLSCAVGFKNGTNGGVRIALDAIGAAEAPHYFLSVTKFGHSAIVSTKGNEDCHIILRGGDKGPNYDAEHIAMVCAEIEKTGRIPHVMVDFSHANSCKQFKKQLEVCDSVCQQIAMGSTQIFGVMVESHLVEGRQDLVDGKAVTYGQSITDACIGWEDSEKVLESLSKAVIQRRNLQQ

SEQ ID NO: 1065 - DNA, 1053 bp, Pasteurella multocida subsp. multocida str. Pm70
  CDS (1)..(1053): transl_table=11
gtgaataaagataacatacataatgtcaatattgttggtgaaaaggtactgattaccccaaaagaattgaaggaaaaactccctctatcccttcctcttcgtagccaaatagcgcaatcacgccgtgatattgcgaatatcatccataaaaaagatcagcgtttattggttgtgattggaccatgttctattcatgatccgatcgcggctttagaatacgcttcacgtttaaaacacttagcagaagaattacaagatcaattgtatattgtgatgcgagtgtattttgaaaaaccaagaacaactgttggctggaaaggattgattaatgatccgaaattggatggttcatttgatgtggaacatggcttacatattgcacgagcattactgctagagctggctgaaatgggactccctttggcaaccgaagcacttgatcccattatgccgcaatatattgctgatctatttagttggtctgcgattggtgcgagaacgacagaatcacaaacgcacagagaaatgtcatcaggtttatccatggcagtgggatttaaaaatggtacggatggcagtttagccaccgcaattaatgcaatgaaagcagcgtcagttggacacagttttattgggattaatcaacaaggtcaagtcaatctattacatacagcgggcaaccctaatgggcatgtgattttgcgtggcggaaaatcaccaaattatgaagctgaacatatcgcactttgtgaacaagaattgcaaaaagcaggtttgacgcaagcaattatgatcgattgtagccatggtaactcgaataaagattaccgtttgcagccgaaagtggcaaaaaatgccgtacagcaaattgtgaagggaaatcgctctattatcgggttgatgttagaaagtcatttatacgcaggtaatcaaagtgctgatcagccattgagtgaaatgcaatatggggtttcgattacggatgcctgtattgattggcagacgacagaacaattattacgtgaaatgacgagcgcattgcgccaaaaataa

SEQ ID NO: 1066 - protein, 350 aa, Pasteurella multocida subsp. multocida str. Pm70
MNKDNIHNVNIVGEKVLITPKELKEKLPLSLPLRSQIAQSRRDIANIIHKKDQRLLVVIGPCSIHDPIAALEYASRLKHLAEELQDQLYIVMRVYFEKPRTTVGWKGLINDPKLDGSFDVEHGLHIARALLLELAEMGLPLATEALDPIMPQYIADLFSWSAIGARTTESQTHREMSSGLSMAVGFKNGTDGSLATAINAMKAASVGHSFIGINQQGQVNLLHTAGNPNGHVILRGGKSPNYEAEHIALCEQELQKAGLTQAIMIDCSHGNSNKDYRLQPKVAKNAVQQIVKGNRSIIGLMLESHLYAGNQSADQPLSEMQYGVSITDACIDWQTTEQLLREMTSALRQK

SEQ ID NO: 1067 - DNA, 1077 bp, Pseudomonas aeruginosa PAO1
  CDS (1)..(1077): transl_table=11
atggctgatttacagatcgacgaccttaacgttgcctccaacgagaccctgatcacgccggagcagctcaagcgtgaaattcccctgaccgacaaggccctgcagaccgtggcccagggtcgccaggtggtgcgcgacatcctggatggcaaggaccaccgtctgttcgtggtgatcggcccctgctccatccacgacatcaaggccgcccacgaatacgccgaccgcctcaaggcgctcgcggccgaagtggcggatacgctgttcctggtgatgcgcgtgtacttcgagaagccgcgtaccacggtgggctggaaaggcctgatcaacgatccgtacctggacgactcgttcaagatccaggatggcctgcacatcggccgccaactgctccgcgaccttgccgagaaaggcttgcccaccgccaccgaagcgctcgacccgatttccccgcagtacctgcaggacctgatcagttggtcggcgatcggcgcccgtaccaccgaatcgcagactcaccgcgagatggcctccggcctgtcttccgcggtcggcttcaagaacggcaccgatggcagcctgaccgtggcgatcaatgccctgcagtcggtctccagcccgcatcgcttcctcggcatcaaccagcagggcggcgtgtccatcgtgaccaccaagggcaaccgctacggtcacgtggtgttgcgcggcggcaacggcaagccgaactacgattcggtcagcgtcgcgctctgcgagcaggacctgaacaaggcgaaaatcccgctgaacatcatggtcgactgcagccacgccaactccaacaaggacccggccctgcaaccgctggtgatggacaacgtcagcaaccagatcgtcgaaggcaacaactcgatcgtcggcctgatggtggaaagccacctgggctggggcagccagccgattccgaaggatctcgaccaacttcagtacggcgtctccatcaccgacgcctgcatcgactgggcgaccaccgagaagagcatccgcagcatgcacgccaagctcaaggacgtgctgccgaaacgccagcgcggctga

SEQ ID NO: 1068 - protein, 358 aa, Pseudomonas aeruginosa PAO1
MADLQIDDLNVASNETLITPEQLKREIPLTDKALQTVAQGRQVVRDILDGKDHRLFVVIGPCSIHDIKAAHEYADRLKALAAEVADTLFLVMRVYFEKPRTTVGWKGLINDPYLDDSFKIQDGLHIGRQLLRDLAEKGLPTATEALDPISPQYLQDLISWSAIGARTTESQTHREMASGLSSAVGFKNGTDGSLTVAINALQSVSSPHRFLGINQQGGVSIVTTKGNRYGHVVLRGGNGKPNYDSVSVALCEQDLNKAKIPLNIMVDCSHANSNKDPALQPLVMDNVSNQIVEGNNSIVGLMVESHLGWGSQPIPKDLDQLQYGVSITDACIDWATTEKSIRSMHAKLKDVLPKRQRG

SEQ ID NO: 1069 - DNA, 1095 bp, Pseudomonas aeruginosa PAO1
  CDS (1)..(1095): transl_table=11
atgaactcatccgtatccgcactgaccaccctttcgccgaacgtccaggccgtcgccctgcccagcgccaccgcccgtaccgccctggaacgcctgcccagcccgctcgaactcaaggcccgccagccgttgccgctggagctggccagccaggtcgccgccagccgcgacgccatccgcgccatcctcgacggcgacgacccgcgcctgctggtggtagtcggtccctgttcgatccacgatccccgctccgccctcgaatacgccgaacgcctcgccgcgctgagcgacgaactcgacggccagttgctcctggtgatgcgcgcctacgtggaaaagccacgcaccacggtgggctggaagggcctcgcctacgatccgcacctggatggcagcgacgacatggccgccggcctggcgctgtcccggcaactgatgctggacatgctgcgcctcggcctgccgctggccaccgaactcctgcaaccgctggccgccggctacttcgacgacctgctgagctgggcggcgatcggcgcgcgcaccagcgaatcgcagatccaccgcgagctggtcagcggcctcggcctgccggtgggcttcaagaacggcaccgacggcggcgtcggcatcgcctgcgacgcgatccgttcggcggcccacggccaccgccatttcggcctcgacccgcacggtcacccggcgctgatcgagacccgcggcaatccggacacccatgtggtgctgcgcggcggccgccacggttcgaactacggccccgagcaggtgcaggccgtgcgccaggccctggaaagccagggcatcgccacgcggatgatggtcgattgcagtcacgccaacagcggcaagaacccgctgaaccagcccggcgtcctcgccagcgtgctggaccagcgcctggccggtgccagcgacctggtcggggtaatgctggaaagccacctgttcgacggttgccaggcgctcggcggcgaactgcgctacggcgtctcgatcaccgacggctgcctcggctgggaaggcaccgagcggattctccgcgacgccgcccggcggctcgccgagcggcgctga

SEQ ID NO: 1070 - protein, 364 aa, Pseudomonas aeruginosa PAO1
MNSSVSALTTLSPNVQAVALPSATARTALERLPSPLELKARQPLPLELASQVAASRDAIRAILDGDDPRLLVVVGPCSIHDPRSALEYAERLAALSDELDGQLLLVMRAYVEKPRTTVGWKGLAYDPHLDGSDDMAAGLALSRQLMLDMLRLGLPLATELLQPLAAGYFDDLLSWAAIGARTSESQIHRELVSGLGLPVGFKNGTDGGVGIACDAIRSAAHGHRHFGLDPHGHPALIETRGNPDTHVVLRGGRHGSNYGPEQVQAVRQALESQGIATRMMVDCSHANSGKNPLNQPGVLASVLDQRLAGASDLVGVMLESHLFDGCQALGGELRYGVSITDGCLGWEGTERILRDAARRLAERR

SEQ ID NO: 1071 - DNA, 1038 bp, Lactococcus lactis subsp. lactis Il1403
  CDS (1)..(1038): transl_table=11
atgagttttaaagaaataagtcctaagataaatattgatgcaattaagatgttgggacatctcaacagtgagcaacaagaaaaaaaattgcaacgagataaagaacttgaagcaattataaaaggtgaagatgaccgtttactcttgattattgggccatgttcgtcagacaatgaagaagcagttttagaatatgctcgccgtttagctaaacttcaagaagcagttaaagataaaatttttatggtcatgcgtgtctatactgcaaaacctcgtacaaatggcgatggctataaaggattgattcacgaaccagatgctgatggtcataccgatttaatcaatggaatcaaaatggttcgtgacttacattacaaggtcatcactgaaactggtttaacaactgctgatgaaatgctttacccagaaaatcttccaatggtagatgatttggtcagctaccatgcgattggtgcacgttctgttgaaaatcaacaacaccgttttgttgcttctgggattgatgtgccaactggtttgaaaaatccaacatcaggaaatttgaaagtgatgtttaatggaatttacgcggctcaacaatcacaagatttcctctttggtcgtgcagaagttcaaacatcaggaaatcctttagcacatgcgattttgcgtggtggacaagatgaaaatggaaaataccatccaaactactacactgataacttgcttgatacaattgaaatttatgaaaaaatgggcttgaaaaatccttttattgtcattgatacaaaccatgataactctggtaagaaatttatggaacaaatccgtattgttcgtcaaaccttagttaatcgtgactgggatgataaaattcgccaaaatgttcgtggcttcatgattgaatcttacctagaagatggtcgccaagataaaccagaagtatttggtaaatcaattactgacccatgtttaggttgggataaaacagaagcacttgttcaagaaatttacgaagctgaaaacaaaaataactaa

SEQ ID NO: 1072 - protein, 345 aa, Lactococcus lactis subsp. lactis Il1403
MSFKEISPKINIDAIKMLGHLNSEQQEKKLQRDKELEAIIKGEDDRLLLIIGPCSSDNEEAVLEYARRLAKLQEAVKDKIFMVMRVYTAKPRTNGDGYKGLIHEPDADGHTDLINGIKMVRDLHYKVITETGLTTADEMLYPENLPMVDDLVSYHAIGARSVENQQHRFVASGIDVPTGLKNPTSGNLKVMFNGIYAAQQSQDFLFGRAEVQTSGNPLAHAILRGGQDENGKYHPNYYTDNLLDTIEIYEKMGLKNPFIVIDTNHDNSGKKFMEQIRIVRQTLVNRDWDDKIRQNVRGFMIESYLEDGRQDKPEVFGKSITDPCLGWDKTEALVQEIYEAENKNN

SEQ ID NO: 1073 - DNA, 1023 bp, Lactococcus lactis subsp. lactis Il1403
  CDS (1)..(1023): transl_table=11
atgacttttaaagaactcagtaacaaaattaacattaaagatgtaagagagctaaatcatttaaatgatgagcaacaagaaaagaaagaaaaacgtgataaggaacttgaagcgataattaagggtgaagacgatagaatcctcttagtcattggcccctgctcatcggataatgaagctgcagttctagaatatgctcacagattgttaaaacttcaaaaagaagtagaagataaaatttttattgtgatgcgtgtttatactgcaaaaccgcggacaaacggagatggctataaaggcctcattcacgaacctgatgcagatggacatacagaccttatcaatgggataaaaatggttcgtgaccttcactataaagtaattactgaaactggtctgactacagcagatgagatgctatacccagaaaatctaccattagttgatgacttagtaagttactatgcagttggcgctcgctcagttgaaaatcaacaacatcgctttgttgcctcaggaatagatgccccaacaggaatgaaaaacccgacatcagggaatttaaaagttatgtttaatggaatgtatgcagcccaacaatctcaagattttctatttgggaatgctgaagtagaaacatcaggaaatccattagctcatgccatccttcgtggtggacaagatgaaaatggtaaaaaccatccaaattactatacagataatcttcttgaaagtatcgaaatatacgaaaaaatgggtttacaaaatccatttattgttattgatactaatcatgataactctgggaagaagtatatggaacaaataagaattgttcgtcaaacattagtcaatcgtaattgggatgaacaaattcataaatatgtcagaggatttatgattgaatcatatcttgaagacggtcgtcaagacaaaccagaagtatttggaaaatcaatcactgacccatgtttgggttgggataaaacagaagaacttattaatgaaatttataattcgtga

SEQ ID NO: 1074 - protein, 340 aa, Lactococcus lactis subsp. lactis Il1403
MTFKELSNKINIKDVRELNHLNDEQQEKKEKRDKELEAIIKGEDDRILLVIGPCSSDNEAAVLEYAHRLLKLQKEVEDKIFIVMRVYTAKPRTNGDGYKGLIHEPDADGHTDLINGIKMVRDLHYKVITETGLTTADEMLYPENLPLVDDLVSYYAVGARSVENQQHRFVASGIDAPTGMKNPTSGNLKVMFNGMYAAQQSQDFLFGNAEVETSGNPLAHAILRGGQDENGKNHPNYYTDNLLESIEIYEKMGLQNPFIVIDTNHDNSGKKYMEQIRIVRQTLVNRNWDEQIHKYVRGFMIESYLEDGRQDKPEVFGKSITDPCLGWDKTEELINEIYNS

SEQ ID NO: 1075 - DNA, 1056 bp, Neisseria meningitidis MC58
  CDS (1)..(1056): transl_table=11
atgacacaccattaccccacagacgatattaagattaaagaagttaaagagttgttgccgccgatagcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcgcgcagcctgttgttgtcgctgaacaatatgggtatgcctgcctctaccgagtttttggatatgattacgccgcaatattatgcggacttgatttcttggggggcaatcggtgcgcggacgaccgaaagccaagttcaccgcgaattggcaagcgggctgtcctgccccgtcggctttaaaaacggtacggacggcaatttgaagattgccatcgacgcaatcggtgcggcgagccattcgcatcatttcctgtctgtaaccaaggccgggcattccgccattgtccataccggcggcaatcccgactgtcatgtcattttgcgcggcggcaaagagccgaattatgatgcggaacacgtcagcgaggcggcggaacaactgcgtgcggcaggggtaaccgacaagctgatgatagattgcagccacgccaacagccgcaaggattacactcggcagatggaagtggcacaagacattgccgcccaattggaacaggacggcggcaatatcatgggcgtgatggtggaaagccatttggtcgaaggcagacaggacaagccggaagtgtacggcaagagcattaccgatgcgtgtatcggttggggcgcgactgaagaactgttggcattgttggcaggtgcaaacaaaaaacgtatggcgcgcgccagttga

SEQ ID NO: 1076 - protein, 351 aa, Neisseria meningitidis MC58
MTHHYPTDDIKIKEVKELLPPIAHLYELPISKEASGLVHRTRQEISDLVHGRDKRLLVIIGPCSIHDPKAALEYAERLLKLRKQYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAEHVSEAAEQLRAAGVTDKLMIDCSHANSRKDYTRQMEVAQDIAAQLEQDGGNIMGVMVESHLVEGRQDKPEVYGKSITDACIGWGATEELLALLAGANKKRMARAS

SEQ ID NO: 1077 - DNA, 1056 bp, Neisseria meningitidis Z2491
  CDS (1)..(1056): transl_table=11
atgacacaccattaccccacagacgatattaagattaaagaagttaaagagttgttgccgccgattgcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcacgcagcctgttgttgtcgctgaacaatatgggtatgcctgcctctaccgagtttttggatatgattacgccgcaatattatgcggacttgatttcttggggggcaatcggcgcgcggacgaccgaaagccaagttcaccgcgaattggcaagcgggctgtcctgccccgtcggctttaaaaacggtacggatggcaatttgaagattgccatcgacgcaatcggtgcggcgagccattcgcatcatttcctgtctgtaaccaaggccgggcattccgccattgtccataccggcggcaatcctgactgtcatgtcattttgcgcggcggaaaagagccgaattatgatgcgggacacgtcagcgaggcggcggaacaactgcgtgcggcaggcgtaaccgacaagctgatgattgattgcagccacgccaacagccgcaaggattacacccgacagatggaagtggcgcaagacattgccgcccaattggaacaggacggcggcaatattatgggcgtgatggtggaaagccatttggtcgaaggcaggcaggacaagccggaagtgtacggcaaaagcattaccgatgcgtgtattggttgggacgcgactgaagaactgttggcattgttggcaggtgcaaacaaaaaacgtatggcgcgcgccggttga

SEQ ID NO: 1078 - protein, 351 aa, Neisseria meningitidis Z2491
MTHHYPTDDIKIKEVKELLPPIAHLYELPISKEASGLVHRTRQEISDLVHGRDKRLLVIIGPCSIHDPKAALEYAERLLKLRKQYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAGHVSEAAEQLRAAGVTDKLMIDCSHANSRKDYTRQMEVAQDIAAQLEQDGGNIMGVMVESHLVEGRQDKPEVYGKSITDACIGWDATEELLALLAGANKKRMARAG

SEQ ID NO: 1079 - DNA, 1086 bp, Deinococcus radiodurans R1
  CDS (1)..(1086): transl_table=11
atgacccagccccccgccccctctaccaccgaaaacctcaacgtgaccggcttcacgccgctgatgaccccgcgtgaactcaaggccgaggtgccgctgaccgacgctgccgagcgcaccgtgctcgccggacgccgggcggcgcaggccatcctgagcggcgaggacgaccgcctactggtggttgtcgggccgtgcagcattcacgaccaggcgcaagcgctggagtacgccgggcggctcgcggcgctgcgtgagcgggtgaaagaccggctggaagtgcagatgcgcgtctacgtggacaaaccgcgcacgacggtgggctggcgcggctacctgctcgaccccgacatggacggcagcaacgacatgggcaagggcgtgcgccgcacccgcgagctgatggtggcggtgagcgaactcgggctgccggtggcgaccgaactgcttgaccccttcgcgccgcagtacctcttcgacgccgtagcctgggcctgcctgggcgcgcgcaccgccgagtcgcagacccaccgggtaatggcgagcgccgtcagtgccccgatgggcttcaagaacggcaccggcggcggtatcaagctcgcggtggacgcggtggtggccgccagtcacccgcacgcttttttcaccattgacgaagatgggcgcgccgcgattgtccacaccaagggcaacgcgcacgggcacgtcattttgcgcggcgggcgtgccggccccaactacgccccgcagttcgtgcaggaagcagcagacctgctgcgcgcggcgggccgcgaagaagccgtcatggtggactgctcgcacgccaactcggggtcggactggacccggcagcgcttggtgtggcgcgacgtgctgggccagcgcctcgccggacagcgcgccatccggggcgccatgctggagagcaacctgcaagccggcaaacagagcctgcctgccgacctcacgcagctcaagcccggcgtgagcgtcaccgacgcctgcgtgggctgggacgaaaccgaggccctgctgctggaggcccacgaacagctcagtggccgcgcggcactggcgacctgctga

SEQ ID NO: 1080 - protein, 361 aa, Deinococcus radiodurans R1
MTQPPAPSTTENLNVTGFTPLMTPRELKAEVPLTDAAERTVLAGRRAAQAILSGEDDRLLVVVGPCSIHDQAQALEYAGRLAALRERVKDRLEVQMRVYVDKPRTTVGWRGYLLDPDMDGSNDMGKGVRRTRELMVAVSELGLPVATELLDPFAPQYLFDAVAWACLGARTAESQTHRVMASAVSAPMGFKNGTGGGIKLAVDAVVAASHPHAFFTIDEDGRAAIVHTKGNAHGHVILRGGRAGPNYAPQFVQEAADLLRAAGREEAVMVDCSHANSGSDWTRQRLVWRDVLGQRLAGQRAIRGAMLESNLQAGKQSLPADLTQLKPGVSVTDACVGWDETEALLLEAHEQLSGRAALATC

SEQ ID NO: 1081 - DNA, 1095 bp, Xylella fastidiosa 9a5c
  CDS (1)..(1095): transl_table=11
atgccaccatttaccgacgacctccgtatccgcaaaattgaaccactgacacctcctaaccagctcctattgcaactaccatgcgatgagcaggcatcgctgactgttgcgacctcacgcaacgcactgcacgatatcctgcacggccacaacgaccgtttagccgtcgtgataggcccatgctcaatccatgatccaattgcagccattgattacgcgcaacgtctacacccattgcgtgagatgtacaaggatgcactagagatcgtgatgcgggtttactttcagaaaccgcgcaccaccattggttggaaaggattggtcaacgatccggatcttgatggcagcttccaaatcaataagggcctgcatatcgcgcgcaacctgctacgcgatatcaatcatctcggcttacccgctggtgtggaatttctagacacgatttcgccgcaatatctggctgacttagtcgcctggggtgccattggtgcacgcaccactgagagccaaatacaccgtgaaatggcttcaggtttatcgtgcccgattggctttaaaaacagtaccagtggtgatgtgaaaattgctgctgacgcgattaaagcagcttcgcatccgcaccatttcctttcagtgacaaagacaggtgttgccgcagtcgtcgccacccagggtaaccccgattgtcacgtgattctacgtggaggcagggtcccgaattacgacgcaatcaatgtcgaagctgccagccaaacattgcttaaatccaagctaccggtgcgactgatgattgatgcgagccatgccaatagcggcaaaaacccaaacaatcaacccaaggtgatcgagaacatcgtagaacagcttgaagccggtgaacgccgcatcgtcggtgtcatgattgaaagccacattgttggtggtcggcaagaattagtccttggaaacacacttacctatggacagagcattaccgatgcttgcatcgactgggatacctcggtcgcaatgttagagcagctcgctcaggccgtacgcgtcagacagactctaccaacgaccgctacaactaacaaaacatcaaaaacccaataa

SEQ ID NO: 1082 - protein, 364 aa, Xylella fastidiosa 9a5c
MPPFTDDLRIRKIEPLTPPNQLLLQLPCDEQASLTVATSRNALHDILHGHNDRLAVVIGPCSIHDPIAAIDYAQRLHPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGRVPNYDAINVEAASQTLLKSKLPVRLMIDASHANSGKNPNNQPKVIENIVEQLEAGERRIVGVMIESHIVGGRQELVLGNTLTYGQSITDACIDWDTSVAMLEQLAQAVRVRQTLPTTATTNKTSKTQ

SEQ ID NO: 1083 - DNA, 1143 bp, Xylella fastidiosa 9a5c
  CDS (1)..(1143): transl_table=11
ttgtctcctccgcttggtctatgtctaaatgttctgagattacatcccatgccaccatttaccgacgacctccgtatccgcaaaattgaaccactgacacctcctaaccagctcctattgcaactaccatgcgatgagcaggcatcgctgactgttgcgacctcacgcaacgcactgcacgatatcctgcacggccacaacgaccgtttagccgtcgtgataggcccatgctcaatccatgatccaattgcagccattgattacgcgcaacgtctacacccattgcgtgagatgtacaaggatgcactagagatcgtgatgcgggtttactttcagaaaccgcgcaccaccattggttggaaaggattggtcaacgatccggatcttgatggcagcttccaaatcaataagggcctgcatatcgcgcgcaacctgctacgcgatatcaatcatctcggcttacccgctggtgtggaatttctagacacgatttcgccgcaatatctggctgacttagtcgcctggggtgccattggtgcacgcaccactgagagccaaatacaccgtgaaatggcttcaggtttatcgtgcccgattggctttaaaaacagtaccagtggtgatgtgaaaattgctgctgacgcgattaaagcagcttcgcatccgcaccatttcctttcagtgacaaagacaggtgttgccgcagtcgtcgccacccagggtaaccccgattgtcacgtgattctacgtggaggcagggtcccgaattacgacgcaatcaatgtcgaagctgccagccaaacattgcttaaatccaagctaccggtgcgactgatgattgatgcgagccatgccaatagcggcaaaaacccaaacaatcaacccaaggtgatcgagaacatcgtagaacagcttgaagccggtgaacgccgcatcgtcggtgtcatgattgaaagccacattgttggtggtcggcaagaattagtccttggaaacacacttacctatggacagagcattaccgatgcttgcatcgactgggatacctcggtcgcaatgttagagcagctcgctcaggccgtacgcgtcagacagactctaccaacgaccgctacaactaacaaaacatcaaaaacccaataa

SEQ ID NO: 1084 - protein, 380 aa, Xylella fastidiosa 9a5c
MSPPLGLCLNVLRLHPMPPFTDDLRIRKIEPLTPPNQLLLQLPCDEQASLTVATSRNALHDILHGHNDRLAVVIGPCSIHDPIAAIDYAQRLHPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGRVPNYDAINVEAASQTLLKSKLPVRLMIDASHANSGKNPNNQPKVIENIVEQLEAGERRIVGVMIESHIVGGRQELVLGNTLTYGQSITDACIDWDTSVAMLEQLAQAVRVRQTLPTTATTNKTSKTQ

SEQ ID NO: 1085 - DNA, 1071 bp, Escherichia coli O157:H7
  CDS (1)..(1071): transl_table=11
atgcaaaaagacgcgctgaataacgtacatattaccgacgaacaggttttaatgactccggcacaactgaaggccgcttttccattaagcctgcaacaagaagcccagattgctgactcgcgtaaaaccatttcagatattatcgccgggcgcgatcctcgtctgctggtagtatgtggcccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggctttaaaaacggcaccgacggcagtctggcaacagcaattaacgctatgcgcgccgccgcccagccgcaccgttttgttggcattaaccaggcagggcaggttgcgttgctacaaactcaggggaatccggacgggcatgtcatcctgcgcggtggtaaagcgccgaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaa

SEQ ID NO: 1086 - protein, 356 aa, Escherichia coli O157:H7
MQKDALNNVHITDEQVLMTPAQLKAAFPLSLQQEAQIADSRKTISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHRFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 1087 - DNA, 1032 bp, Streptococcus pneumoniae TIGR4
  CDS (1)..(1032): transl_table=11
atggcatttattgaaaaaggtcaagaaatcgatatggaagtcatcaaggctgaaacccaattgtctgcggaagccttgagactcaaggaaagccgtgacagggaattggcagatattatttcaggggaagatgaccgtattctcttggtgattggtccttgctcttctgataatgaagaggcggtcttggaatatgctcgccgtttatctgccttgcaaaagaaggtagcggataagattttcatggtcatgcgcgtgtatactgctaagcctcgtaccaatggagacggctataaaggattagttcaccagccagatacttctaaggctccaagcctgattaatggcttgcaggctgtgcgccagttgcactaccgcgtgattacagagactggtttgacaacggcagatgagatgctttatccgtcaaatctgatcttggtggatgacttggtcagctaccatgccgttggagctcgttctgtggaagaccaagagcaccgctttgtggcttctgggattgatgcaccagtagggatgaaaaatccaacctcaggaaatttgggtgttatgtttaacgccatctatgctgctcaaaacaagcaaaccttcctttatcatgggcaggaagttgagacatcaggtaatcctttggcccatgttatcctccgtggagcagtcaacgagtatggcaattatatgccgaattactactatgaaaatctactccaagccattgaacgctatgaaaccatgggacttgaaaatccttttatcctcattgacaccaaccatgataactcaggcaagcaatatatggagcagattcgaattgttcgccagaccttgcagaatcgtgattggaatgagaaaattaaaaagacggttcgaggatttatgattgaatcttacctagcagatggtcgtcaaaaccaaccagagatctttggttgctctattactgacccttgcctaggttgggaaaatacagaggccttggtagaagagatttatgttaccttgacaaaataa

SEQ ID NO: 1088 - protein, 343 aa, Streptococcus pneumoniae TIGR4
MAFIEKGQEIDMEVIKAETQLSAEALRLKESRDRELADIISGEDDRILLVIGPCSSDNEEAVLEYARRLSALQKKVADKIFMVMRVYTAKPRTNGDGYKGLVHQPDTSKAPSLINGLQAVRQLHYRVITETGLTTADEMLYPSNLILVDDLVSYHAVGARSVEDQEHRFVASGIDAPVGMKNPTSGNLGVMFNAIYAAQNKQTFLYHGQEVETSGNPLAHVILRGAVNEYGNYMPNYYYENLLQAIERYETMGLENPFILIDTNHDNSGKQYMEQIRIVRQTLQNRDWNEKIKKTVRGFMIESYLADGRQNQPEIFGCSITDPCLGWENTEALVEEIYVTLTK

SEQ ID NO: 1089 - DNA, 1032 bp, Streptococcus pneumoniae TIGR4
  CDS (1)..(1032): transl_table=11
atggtatttacagcaaaaagctctaaaataaatatagaagaagttcgtgccttgtcaaaattagaaggtcaggctttggagaggaaatcacagcgagatcaagagctagaagccattatacgtggagaagaccagcgaattctcttggtaatcgggccatgctcatctgacaacgaagaagctgtccttgaatacgctaagcgtttggcagtcctacaagaagaagtggcagatcgtatctttatggttatgcgtgtttatactgccaaaccccgtaccaacggagatggctataagggcttgattcaccagcctaacgcgacagaagcgcctagtcttatcaatggaatcaaagccgttcgccatcttcactatcgtgtcatcacagaaacagggatgacaactgctgatgaaatgctttatcctgaaaaccttccgcttgtagatgatttgatttcttacatggcagttggtgcccgttcagttgaagaccagcaacaccgctttgtggcaagtggggcaggattttctactggttttaaaaatccaacctctggaaatctcaatgtcatgtttaatgggatttatgctgctcaaaacaaacaaagtttccttttcttaggaaaagaagtagaaacaactgggaacccgctttcacacgctattcttcgtggtgctcttaatgagtatggaaaaaatattcccaactactattatgacaatttaattgataccattgcccagtatgagaaaatgggcttggaaaatccttttatcatcattgataccaatcatgacaattctggtaagcagtatattgaacagatccgaattgtccgccagaccttgattaaccgtgcttggaatgaaaaaattaagcagttcgttcgtggttttatgattgagtcttatctggaagatggtcgacaaaatgagccagaagtatttggtaagtctatcacagacccttgcctgggttgggataacacagaagctcttgtcagagaaatttacaaaacgttaggagaataa

SEQ ID NO: 1090 - protein, 343 aa, Streptococcus pneumoniae TIGR4
MVFTAKSSKINIEEVRALSKLEGQALERKSQRDQELEAIIRGEDQRILLVIGPCSSDNEEAVLEYAKRLAVLQEEVADRIFMVMRVYTAKPRTNGDGYKGLIHQPNATEAPSLINGIKAVRHLHYRVITETGMTTADEMLYPENLPLVDDLISYMAVGARSVEDQQHRFVASGAGFSTGFKNPTSGNLNVMFNGIYAAQNKQSFLFLGKEVETTGNPLSHAILRGALNEYGKNIPNYYYDNLIDTIAQYEKMGLENPFIIIDTNHDNSGKQYIEQIRIVRQTLINRAWNEKIKQFVRGFMIESYLEDGRQNEPEVFGKSITDPCLGWDNTEALVREIYKTLGE

SEQ ID NO: 1091 - DNA, 1032 bp, Streptococcus pneumoniae R6
  CDS (1)..(1032): transl_table=11
atggtatttacagcaaaaagctctaaaataaatatagaagaagttcgtgccttgtcaaaattagaaggtcaggctttggagaggaaatcacagcgagatcaagagctagaagccattatacgtggagaagaccagcgaattctcttggtaatcgggccatgctcatctgacaacgaagaagctgtccttgaatacgctaatcgtttggcagtcctacaagaagaagtggcagatcgtatctttatggttatgcgtgtttatactgccaaaccccgtaccaacggagatggctataagggtttgattcaccagcctaacgcgacagaagcgcctagtcttatcaatggaatcaaagccgttcgccatcttcactatcgtgtcatcacagaaacagggatgacaactgctgatgaaatgctttatcctgaaaaccttccgcttgtagatgatttgatttcttacatggcagttggtgcccgttcagttgaagaccagcaacaccgctttgtggcaagtggggcaggattttctactggttttaaaaatccaacctctggaaatctcaatgtcatgtttaatgggatttatgctgctcaaaacaaacaaagtttccttttcttaggaaaagaagtagaaacaactgggaacccgctttcacacgctattcttcgtggtgctcttaatgagtatggaaaaaatattcccaactactattatgacaatttaattgataccattgcccagtatgagaaaatgggcttggaaaatccttttatcatcattgataccaatcatgacaattctggtaagcagtatattgaacagatccgaattgtccgccagaccttgattaaccgtgcttggaatgaaaaaattaagcagttcgttcgtggttttatgattgagtcttatctggaagatggtcgacaaaatgagccagaagtatttggtaagtctatcacagacccttgcctgggttgggataacacagaagctcttgtcagagaaatttacaaaacgttaggagaataa

SEQ ID NO: 1092 - protein, 343 aa, Streptococcus pneumoniae R6
MVFTAKSSKINIEEVRALSKLEGQALERKSQRDQELEAIIRGEDQRILLVIGPCSSDNEEAVLEYANRLAVLQEEVADRIFMVMRVYTAKPRTNGDGYKGLIHQPNATEAPSLINGIKAVRHLHYRVITETGMTTADEMLYPENLPLVDDLISYMAVGARSVEDQQHRFVASGAGFSTGFKNPTSGNLNVMFNGIYAAQNKQSFLFLGKEVETTGNPLSHAILRGALNEYGKNIPNYYYDNLIDTIAQYEKMGLENPFIIIDTNHDNSGKQYIEQIRIVRQTLINRAWNEKIKQFVRGFMIESYLEDGRQNEPEVFGKSITDPCLGWDNTEALVREIYKTLGE

SEQ ID NO: 1093 - DNA, 1071 bp, Yersinia pestis CO92
  CDS (1)..(1071): transl_table=11
atgcaaaaagactcgctcaataacgtccatatcagtgccgaacaaatcctgataaccccggaagaactgaaaaatcagtttccactgagcgaaaatgatcagtattcgatagagcgcgcacgtaaaaccattgctgacattattcaggggcgagatccgcgtctgttggtcgtttgtgggccctgttcaattcatgatgtggatgcggcactggattacgcgcgtcgtttgaaaaaactctctgtggaattggatgacagcttatatatcgttatgcgtgtctattttgagaagccaagaactaccgtgggttggaaaggcctgatcaatgaccctgcaatggatggttcatttgatgtagaggcaggtttacacattgcccgtcgtttattgctggatttagtgggcatggggttgccgttagcgactgaagctctggatcctaatagcccacaatatttaggtgacctgttcagttggtcggccattggtgcccgtacaacggagtcacagacccaccgtgaaatggcatcaggcttgtctatgccggttggatttaaaaatggcactgacggtagcctaggcacggcaatcaatgcaatgcgcgccgctgccatgccacatcgctttatggggatcaatcagtcgggccaggtctgcctgttacaaactcagggtaacccacacggccatgtcattctacggggaggtaaaacaccaaactacagtgcacaagatgtcgctcagtgtgaaaaacagatgcaggatgcgggactcatcccatccttaatgatagattgcagtcacggtaattcaaataaagactaccgccgtcaggttgcggtggctgaatctgtggttgaacagatcaaggcgggcaatcgttcaattacaggtgtgatgctggaaagccacatccacgaaggaaatcagtcatctgaacagccacgtgctgatatgcgctacggtgtttctgtgactgacgcctgtattaactgggaaagcactgaaaccctgttacgtggtatgcgccaagaattgcttgcagcactgacggcacggactgcatga

SEQ ID NO: 1094 - protein, 356 aa, Yersinia pestis CO92
MQKDSLNNVHISAEQILITPEELKNQFPLSENDQYSIERARKTIADIIQGRDPRLLVVCGPCSIHDVDAALDYARRLKKLSVELDDSLYIVMRVYFEKPRTTVGWKGLINDPAMDGSFDVEAGLHIARRLLLDLVGMGLPLATEALDPNSPQYLGDLFSWSAIGARTTESQTHREMASGLSMPVGFKNGTDGSLGTAINAMRAAAMPHRFMGINQSGQVCLLQTQGNPHGHVILRGGKTPNYSAQDVAQCEKQMQDAGLIPSLMIDCSHGNSNKDYRRQVAVAESVVEQIKAGNRSITGVMLESHIHEGNQSSEQPRADMRYGVSVTDACINWESTETLLRGMRQELLAALTARTA

SEQ ID NO: 1095 - DNA, 1110 bp, Caulobacter crescentus CB15
  CDS (1)..(1110): transl_table=11
atgccgtccacgtccaccgctcacctcgtcaccctgcccgttccgaccgatgatctgcggatcgagaaactccagaccctgagcccgccggctcaggtcatcggagaagctcccgccacctcgtcagtggccgagatcgtcggcggggcgcgtcaggcggttcatcagatcctgcacggccaggacgaccgcctcgtcgtggtcatcggcccctgctccattcacgaccccaaggcggcgatcgactacgcccggcgcctcgccgccgagcgcgagcgccacgcgggcgaactggaagtgatcatgcgggtctatttcgagaagccgcgcacgaccgtgggctggaagggcctgatcaacgatccgggcctcgacggcggcttccggatcaatgacggcctgcgtctggcgcgacgggttctgctggacgtcagcgcgcagggcctgccggccgcctgcgagttcctggacgtgaccaccccgcagtacatcgctgacctggtatcctggggcgcgatcggcgcccgcaccaccgagagccagattcaccgcgaactggcctcgggcctttcctgccccgtcggtttcaagaacggcaccaatggcgatgtgaagatcgccgtcgacgccgtaatggccgcgtcccagccgcaccacttcctggccgtcaccaaagagggccgcgcggcgatcgccaccacgacgggcaatggtgactgtcacctcgtgctgcgcggcggcaagaccccgaactacgacgccgccagcgtcgccgccgccgcagaggttctgagcaaggccggactgccgcagcgcctgatggtcgatgtcagccacgccaacagcggcaagaaccatgagaaccaacccgccgtgatcgccgacgtctgcgcccaggtcgcgaccggcgcctcgccggtcatgggcgtgatgatcgagagcaatctcgtggccggccgccaggatatcgtccaaggccagggcctgacctatggtcagtcggtcaccgacgcctgcgtcgactgggaaacctcggtgcggctgctggacgacctggcgggcgcagttcgcgcgggtcgcctggcgcggggctctaaatcaagcacttag

SEQ ID NO: 1096 - protein, 369 aa, Caulobacter crescentus CB15
MPSTSTAHLVTLPVPTDDLRIEKLQTLSPPAQVIGEAPATSSVAEIVGGARQAVHQILHGQDDRLVVVIGPCSIHDPKAAIDYARRLAAERERHAGELEVIMRVYFEKPRTTVGWKGLINDPGLDGGFRINDGLRLARRVLLDVSAQGLPAACEFLDVTTPQYIADLVSWGAIGARTTESQIHRELASGLSCPVGFKNGTNGDVKIAVDAVMAASQPHHFLAVTKEGRAAIATTTGNGDCHLVLRGGKTPNYDAASVAAAAEVLSKAGLPQRLMVDVSHANSGKNHENQPAVIADVCAQVATGASPVMGVMIESNLVAGRQDIVQGQGLTYGQSVTDACVDWETSVRLLDDLAGAVRAGRLARGSKSST

SEQ ID NO: 1097 - DNA, 1053 bp, Salmonella typhimurium LT2
  CDS (1)..(1053): transl_table=11
atgaattatcagaacgacgatttacgcattaaagaaatcaacgagttattacctccggtcgcgctgctggaaaagtttcccgccacggaaaatgcagcaaataccgttgctcacgcgcgcaaagccatccataaaattctcaaaggcaatgacgatcgtctgctggtggtgatcggtccttgttcaattcatgatccggcagcggcgaaagagtatgccgcccgtttgctggcgctacgcgatgagcttcaaggcgagcttgaaattgtcatgcgcgtctattttgagaaaccgcgtaccaccgtcggctggaaagggctgattaacgatccgcacatggataacagcttccagattaacgacggtctgcgtattgcgcgcaaactgctgctggatattaacgacagcggcctgcctgccgccggcgaattcctcgatatgatcacgccgcaatatctggccgatctgatgagctggggcgccattggcgcgcggactactgaatcccaggttcatcgcgaattggcgtctggcctctcttgtccggtcggttttaaaaatggtactgatggcacgattaaagtcgccattgacgccatcaacgccgccggcgcgccgcattgcttcctctccgtcactaaatggggtcattcggcgattgtgaataccagcggcaacggcgactgccatatcattctgcgcggcggtaaagcgccaaactatagcgcgcagcatgttgctgaggtgaaagaaggcctcaccaaagcgggactgacgccgcaggtcatgatcgatttcagccatgccaactcctgtaagcaatttcaaaagcagatggaggtttgcgccgatgtctgccagcagatagcgggcggtgaaaaagcgattattggcgtgatggtagagagtcatctggtagaaggaaaccagagtctggaaagcggtcagccgctgacctacggtaaaagcattactgacgcctgtattggctgggaagataccgatgcgctgcttcgtcagttgtcggcagcggtaaaagcccgtcgcggctaa

SEQ ID NO: 1098 - protein, 350 aa, Salmonella typhimurium LT2
MNYQNDDLRIKEINELLPPVALLEKFPATENAANTVAHARKAIHKILKGNDDRLLVVIGPCSIHDPAAAKEYAARLLALRDELQGELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKAPNYSAQHVAEVKEGLTKAGLTPQVMIDFSHANSCKQFQKQMEVCADVCQQIAGGEKAIIGVMVESHLVEGNQSLESGQPLTYGKSITDACIGWEDTDALLRQLSAAVKARRG

SEQ ID NO: 1099 - DNA, 1131 bp, Nostoc sp. PCC 7120
  CDS (1)..(1131): transl_table=11
atgatgaatttgtgttgtacatttcatctacaatatgtatacccaatctgcctaaaatcctacccagacaattcagagcaatcctccatgcacaataaattaactaacgcaaatattgaaaattatcacgttctcttaactccaaacgcagtaaaagaaaaattaccgttaacagaaactgcggcagaaatagttttacagtttagatgtgaaatagagaaaatcttagattttcaagatagacgcaaatttatagtagttgggccttgttccattcatgaccctaatgcagcattggaatacgcccataagttaaaaaaattagctgaacgtgtccaggataaactactgttgattatgcgggtgtattttgaaaagccccgcacaactgtaggctggaaaggattaattaatgatccagaaatggatgattcttttcatgtggaaaatggtttattgctagccagagatttactgatcaagctaacagagttagggctacccaccgctacagaagctctagaccctatcgtaccccaatatattggtgaattgatcacatgggcggcgatcggcgcacgcacaacagaatcccagactcacagggaaatggctagtggtctgtctatgcccgtgggctttaaaaatggcactgatggtaatattcaagtagctttaaatgctttacattctgccagaatgactcataattttttgggcattaatcctgagggacaggtcagtgtatttgaaacgaaaggtaatgcttacggtcatgtgattttgcgtgggggaaatcaacctaattttgatgttgcaagtgttaaacaagtagaagaaaaattaaaacaggctcagttacctccgagaattgtcattgattgtagtcatggtaatactaataagaattacaggttgcaatctgatgttttagaaaacgttgtacaacaaatagttgatggtaatacatcgattgtggggatgatgctggaatcaaatttatatgaaggtaatcaacccattaactgcaaacgggaagaattgaaatatggggtttctgtaactgacccctgtatcggttgggagcaaacggaaaaaattatcttggctgcttacgaaaaacttaattga

SEQ ID NO: 1100 - protein, 376 aa, Nostoc sp. PCC 7120
MMNLCCTFHLQYVYPICLKSYPDNSEQSSMHNKLTNANIENYHVLLTPNAVKEKLPLTETAAEIVLQFRCEIEKILDFQDRRKFIVVGPCSIHDPNAALEYAHKLKKLAERVQDKLLLIMRVYFEKPRTTVGWKGLINDPEMDDSFHVENGLLLARDLLIKLTELGLPTATEALDPIVPQYIGELITWAAIGARTTESQTHREMASGLSMPVGFKNGTDGNIQVALNALHSARMTHNFLGINPEGQVSVFETKGNAYGHVILRGGNQPNFDVASVKQVEEKLKQAQLPPRIVIDCSHGNTNKNYRLQSDVLENVVQQIVDGNTSIVGMMLESNLYEGNQPINCKREELKYGVSVTDPCIGWEQTEKIILAAYEKLN

SEQ ID NO: 1101 - DNA, 1179 bp, Ralstonia solanacearum GMI1000
  CDS (1)..(1179): transl_table=11
atgggcaatcggcggactgccccggtttcggcgcaccgctcgtgtttccaggagttttccgtgattcgcatcgacaatccccaaagcgaccaagaagtcggcgtggccgacgctacccaggacaccacccgcatcgatgacgtgcgcatcggtgcggtccgtccgctcatttccccggcactcctgctcgacgagttgcccgtgtcgcccgccgtgcaggcgcacgtcgaagcgagccgggccgcggtcacggacatcctgcacggacgggacgatcgcctgcttgccgtggtgggcccgtgctcgatccacgatcacgaccaggcgctcgactacgcccatcggctcgggacggccgcgaatcgcctgcgcgacgatctgctgatcgtcatgcgcgtgtatttcgaaaagccgcgcacgaccgtcggctggaagggctacatcaacgatccgcggctcgacggcagcttccgcatcaacgaagggctgcgccgtgcgcgccagttgctcctggaagtcaacgcgatgggattgccggcggccaccgagtttctcgatctgctgagtccgcagtacatcgcggacctgattgcctggggcgcgatcggcgccaggacgacggaaagccagagccatcggcagctcgcctcgggactgagctgtcccatcggcttcaagaacggcacggatggcggtgtccagatcgcggcggacgcgattctggcggcgcggtcgagccactcgttcatgggcatgacgaagatggggatggccgcgattttcgagacgcgcggcaacggtgatgcgcacgtcattcttcgcggcggcaagaagggaccgaactatgacgcggcggccatcgaagacagctgcgcgattctccgggcggccgggctgcgcgagcaggtgatggtcgactgttcgcacgcgaactcgggcaagtcccatgcccgtcaagccgacgttgcgcgggatctggcgcagcagctgtcgtccggcgagcggcgcatcagcggcgtgatgatcgagagccatctggaagaggggcgccaggatctgaaacccggcgtgccgttgcagcgcggcgtgtccattaccgatgcctgccttgggtggtcccagacggaaccgttgctggaaaccctcgcaacggctgtgcgtgcgcggcggcgcggctag

SEQ ID NO: 1102 - protein, 392 aa, Ralstonia solanacearum GMI1000
MGNRRTAPVSAHRSCFQEFSVIRIDNPQSDQEVGVADATQDTTRIDDVRIGAVRPLISPALLLDELPVSPAVQAHVEASRAAVTDILHGRDDRLLAVVGPCSIHDHDQALDYAHRLGTAANRLRDDLLIVMRVYFEKPRTTVGWKGYINDPRLDGSFRINEGLRRARQLLLEVNAMGLPAATEFLDLLSPQYIADLIAWGAIGARTTESQSHRQLASGLSCPIGFKNGTDGGVQIAADAILAARSSHSFMGMTKMGMAAIFETRGNGDAHVILRGGKKGPNYDAAAIEDSCAILRAAGLREQVMVDCSHANSGKSHARQADVARDLAQQLSSGERRISGVMIESHLEEGRQDLKPGVPLQRGVSITDACLGWSQTEPLLETLATAVRARRRG

SEQ ID NO: 1103 - DNA, 1080 bp, Ralstonia solanacearum GMI1000
  CDS (1)..(1080): transl_table=11
atgccgaagaacaccgacgacctgcgcattcgcgaactgaaagagctgaccccgccggcgcacctgatccgcgaattcccgtgcaacgacgccgtttccgagctgatctaccagagccgcacggcgatgcaccgcatcctgcacggcatggacgaccgcctgatcgtcatcatcgggccgtgctcgatccacgacaccaaggccgccctcgactacgcgcgccgcctggtcgaacagcgcgagcgcttcaaggccgacctggaaatcgtcatgcgcgtgtacttcgagaagccgcgcaccacggtcggctggaagggcctgatcaacgacccgtacatggacggcagcttcaagatcaacgacggcctgcgcaccgcgcgcgagctgctggtgaacatcaacgagctgggcgtgccggcgggcaccgaatacctcgacatgatcagcccgcagtacatcgccgacctggtgagctggggcgcgatcggggcgcgcacgaccgaatcgcaggtgcaccgcgaactcgcctccggactgtcgtgcccggtcggcttcaagaacggcaccgatggcaacgtgaagatcgccgtggacgcgatcaaggcggcgtcgcagccgcaccacttcctgtcggtcaccaagggcggccactcggccatcgtgtcgacggcgggcaacgaggattgccacatcatcctgcgcggcggcaaggcgcccaactacgatgccgccagcgtgcaggcggcctgcgaagacatcgccaagtccggcctggccgcgcgcctgatgatcgatgcctcgcacgccaacagcagcaagaagcacgagaaccagatcccggtctgcgaagacatcggccgccagatcgccggcggcgacgaccgcatcgtcggcgtgatggtggaatcgcacatcaatgccggccgccaggaccacgtgcagggcaccccggtcgaggacctgaactacggccagagcgtgaccgacgcctgcatcggctgggacgattcgctcaaggtactggaaacgctggccgacgccgtgcgcaagcgccggctggtgccccgcaacggcaactga

SEQ ID NO: 1104 - protein, 359 aa, Ralstonia solanacearum GMI1000
MPKNTDDLRIRELKELTPPAHLIREFPCNDAVSELIYQSRTAMHRILHGMDDRLIVIIGPCSIHDTKAALDYARRLVEQRERFKADLEIVMRVYFEKPRTTVGWKGLINDPYMDGSFKINDGLRTARELLVNINELGVPAGTEYLDMISPQYIADLVSWGAIGARTTESQVHRELASGLSCPVGFKNGTDGNVKIAVDAIKAASQPHHFLSVTKGGHSAIVSTAGNEDCHIILRGGKAPNYDAASVQAACEDIAKSGLAARLMIDASHANSSKKHENQIPVCEDIGRQIAGGDDRIVGVMVESHINAGRQDHVQGTPVEDLNYGQSVTDACIGWDDSLKVLETLADAVRKRRLVPRNGN

SEQ ID NO: 1105 - DNA, 1119 bp, Schizosaccharomyces pombe 972h-
  CDS (1)..(1119)
atgtctccggtttttttacccagcggtgaaacttacgatcaagagcatcttgatgacaaccgtgtcttaggttacaaccctttggttcctgccgctttggttcaacaagagattcctgtttctgaaacttctcgcaaagtcatcactgactccagaaaggagattcaagctattctcaacaaacaagatgacagaattatcgttgttgtcggtccttgctccattcatgaccctaaattggccatggactatgctaagttgctgaagcccaaagctgacgagcttcaggatgctttgtgcgttgtcatgcgttgttatttggagaagccccgtactactatcggatggaagggtttggtcaacgaccctaacttggatggttcttttgctatcaacaagggtattaggatggctcgtcaaatgtattgcgacgttaccaattttggcattcctttggccagtgagatgttggacaacatttctccccaattcttcgccgacttactcagttttggtgctatcggtgctcgtactaccgagtctcaattacatcgtgaattggcttctgccctttccttccctgttggtttcaagaatggtactgatggtactgttggtgtggcgattgatgccattggtgctaccgcccatcctcacacaatgctaggagttactaaacaaggtctcgccgctattaccatgaccaggggcaacaaggataccttcatcattttgcgtggtggtaagaagggtcctaactatgatgctgagcacgttgccgccgttcgcaaagatcttgagaaggccaaccttcctcctcgtatcatgatcgattgctctcatggcaactcaagcaagaatcatttgaaccaaccaaaggtctccaagagcatcgccgaacaaatcagaaatggcgactcttccattgttggtgttatgattgaatctcatatcaatgaaggtcgtcaagatgctccaatccgtcctggcgttaaggatactctcaagtacggtgtcagtatcactgatgcttgtgttagctgggaacaaactgctccaatgctagacgatcttgctgaagctgtccgtgctcgccgtcaaaaccaaaaaagtaattaa

SEQ ID NO: 1106 - protein, 372 aa, Schizosaccharomyces pombe 972h-
MSPVFLPSGETYDQEHLDDNRVLGYNPLVPAALVQQEIPVSETSRKVITDSRKEIQAILNKQDDRIIVVVGPCSIHDPKLAMDYAKLLKPKADELQDALCVVMRCYLEKPRTTIGWKGLVNDPNLDGSFAINKGIRMARQMYCDVTNFGIPLASEMLDNISPQFFADLLSFGAIGARTTESQLHRELASALSFPVGFKNGTDGTVGVAIDAIGATAHPHTMLGVTKQGLAAITMTRGNKDTFIILRGGKKGPNYDAEHVAAVRKDLEKANLPPRIMIDCSHGNSSKNHLNQPKVSKSIAEQIRNGDSSIVGVMIESHINEGRQDAPIRPGVKDTLKYGVSITDACVSWEQTAPMLDDLAEAVRARRQNQKSN

SEQ ID NO: 1107 - DNA, 1074 bp, Xanthomonas campestris pv. campestris str. ATCC 33913
  CDS (1)..(1074): transl_table=11
atgccgccgctgaccgatgacctgcgtatccgcaagatcgaaccgttgaccccgccctcgcagctgctgtcgctgctgccctgcgatgagcgcgcttccgaaaccgtcaccaacgcacgtgccgccctgcacgagattctgcacgggcgcgatgaccgcctggcggtggtgatcggcccctgttcgatccacgaccctgtggctgccatggagtacgcgcagcgtctgcgccccttgcgtgagcagtttggcgacgcgctggaaatcgtgatgcgcgtgtacttcgaaaagccgcgcaccaccattggctggaagggcctgatcaacgacccggacctggatggcagtttccagatcaacaagggcctgcgcgtggcgcgtggcttgctgcgcgatatcaacaacctcggcctgccggccggcgtggaatttctcgacatcatctcgccgcagtacatcgctgacttggtggcctggggcgcgatcggtgcgcggaccaccgaaagccaggtgcatcgcgaaatggcctccggcctgtcgtgcccagtggggttcaagaacggcaccggtggcgacgtcaagattgccgtggacgcggtgggtgcggcctcgcatccgcatcatttcctggcggtgaccaaggatggccacacggcggtggcggccaccgcgggcaacccggattgtcatgtgattttgcgtggcggcaagcagcctaacttcgacgcggccaatgtggaagcatccagccaggtgctcaacaaggccggcttgccggcgcggctgatgatcgacgccagccacgccaacagcggcaagaacccggacaaccagcccaaggtcatcgacgacatcgccacgcagctggagggcggcgagacgcgcatcgttggcgtgatggtggaaagccacctggtcggcggccggcaggaactggtgccgggcggcacgctgacctacggccaaagcatcaccgacggctgcctggattgggacgcctcgctgcaggtgctggagcgcttggcgattgcggtgcgtgcacgtcgtgcgcggcgggttgccgaggctgcgtga

SEQ ID NO: 1108 - protein, 357 aa, Xanthomonas campestris pv. campestris str. ATCC 33913
MPPLTDDLRIRKIEPLTPPSQLLSLLPCDERASETVTNARAALHEILHGRDDRLAVVIGPCSIHDPVAAMEYAQRLRPLREQFGDALEIVMRVYFEKPRTTIGWKGLINDPDLDGSFQINKGLRVARGLLRDINNLGLPAGVEFLDIISPQYIADLVAWGAIGARTTESQVHREMASGLSCPVGFKNGTGGDVKIAVDAVGAASHPHHFLAVTKDGHTAVAATAGNPDCHVILRGGKQPNFDAANVEASSQVLNKAGLPARLMIDASHANSGKNPDNQPKVIDDIATQLEGGETRIVGVMVESHLVGGRQELVPGGTLTYGQSITDGCLDWDASLQVLERLAIAVRARRARRVAEAA

SEQ ID NO: 1109 - DNA, 1074 bp, Xanthomonas axonopodis pv. citri str. 306
  CDS (1)..(1074): transl_table=11
atgccgcccgtcaccgatgacctgcgtatccgcaagatcgaagccctcgcaccgcccgcgcagctgctgtcgctgctgccctgcgatgagcgcgcctccgaaaccgtgaccaacgcgcgcgccgcgctgcacgacatcctgcatgggcgcgacgaccgcctggccgtggtgatcgggccatgctcgatccacgacccggtcgcggcgatggagtacgcgcaacgcttgcgcccgttgcgcgatcagttcggcgacgcgctggagatcgtgatgcgggtgtacttcgaaaagccgcgcaccaccatcggctggaagggcttgatcaacgatccggacctggacggcagcttccagatcaacaagggcctgcgcgtggcgcgtggcctgctgcgcgatatcaacaatctcggcctgccggccggcgtggaatttctcgacatcatttcgccgcaatacatcgccgacctggtggcctggggcgcgatcggcgcacgcaccaccgagagccaggtgcatcgcgaaatggcgtccgggctgtcatgcccggtgggcttcaagaacggcaccggtggcgacgtcaagattgcggtggacgcggtgggcgcggcctcgcatccgcatcatttcctggccgtgaccaaggacggacataccgccgtggcagcgacggcgggcaatccggattgccatgtgatcctgcgcggcggcaaacagcccaacttcgatgcggccaatgtggaagcggccagccaggtgctcaatgcatccggcctgcccgcgcgcctgatgatcgatgccagccacgccaacagcagcaagaatcccgagaaccagcccaaggtcgtcgaggacatcgccaaccagctggaaggcggcgaaacacgcatcgtcggcgtgatggtggaaagtcacctggtcggtggacgccaggacctcttgccggggtgcgagctgacctacggccagagcattaccgacggctgcatcggctgggacagttcggtgcaggtgctggaacgcctggcgaccgcagtgcgcgcacggcgcatgcgccggattgccgaggctgcatga

SEQ ID NO: 1110 - protein, 357 aa, Xanthomonas axonopodis pv. citri str. 306
MPPVTDDLRIRKIEALAPPAQLLSLLPCDERASETVTNARAALHDILHGRDDRLAVVIGPCSIHDPVAAMEYAQRLRPLRDQFGDALEIVMRVYFEKPRTTIGWKGLINDPDLDGSFQINKGLRVARGLLRDINNLGLPAGVEFLDIISPQYIADLVAWGAIGARTTESQVHREMASGLSCPVGFKNGTGGDVKIAVDAVGAASHPHHFLAVTKDGHTAVAATAGNPDCHVILRGGKQPNFDAANVEAASQVLNASGLPARLMIDASHANSSKNPENQPKVVEDIANQLEGGETRIVGVMVESHLVGGRQDLLPGCELTYGQSITDGCIGWDSSVQVLERLATAVRARRMRRIAEAA

SEQ ID NO: 1111 - DNA, 1062 bp, Chlorobium tepidum TLS
  CDS (1)..(1062): transl_table=11
atgcaacaactacaggatttacgagtttcaagaatcattactcttagctcgccaaaggcactgaaggaaaaattgcccgtaacggagcatattgccgatacggtctacaaggctaggcaggaagttgagaatattctgaccggcaaggacagccgtatgctggtcatcgtcggcccatgctccattcacgacatcaaggcggctcgtgactatgcctcgcgcctttttgctttgcgcaaagaactcgaatcggagttctgcattgtcatgagggtttatttcgagaaaccacggacgaccatcggctggaaagggttcatcaacgaccctcatctcaacgatacctacgatatcgagcatggcctgttccatgcccgaaagctgttgattgagctgaatgaaatgggcctgcccgcagccacggagtttctcgatccgatctcgccgcaatatgttgctgacctgatcagctgggcagccattggcgcgcgtaccatcgagtcacagactcaccgccagatggccagtggcctgtcaatgccggtcggttttaaaaacgcgaccgatgggcgccttcaggtggccatcgacgctattcggtcggcgatgcaccagcacagttttctcggaatcgaccaagacgggcacagcagcgtcatcaccaccaaagggaacccgtttggccatctcgtgctgcgcggcggctctagcaagccgaactacgatgccgacagcatcgcccatgctgaaaaacagttgcgcaaggccgacctgactccgcatctgctggtcgattgcagccatgctaactccggcaagaagtgtggtaatcagctcaaggtctgggccgatattcttgcccagaaggagcagggcaacaccagcatcgtaggggtcatgatcgagagcaatatcttctctggaaaccagcctttcccggtcgatccgagagagctgcaatacggcgtctcgattaccgacgagtgcgtctcttgggaggagaccgagaggatgcttcgggatggagccgcattcatgaagcaggttcgctcgaaagcctga

SEQ ID NO: 1112 - protein, 353 aa, Chlorobium tepidum TLS
MQQLQDLRVSRIITLSSPKALKEKLPVTEHIADTVYKARQEVENILTGKDSRMLVIVGPCSIHDIKAARDYASRLFALRKELESEFCIVMRVYFEKPRTTIGWKGFINDPHLNDTYDIEHGLFHARKLLIELNEMGLPAATEFLDPISPQYVADLISWAAIGARTIESQTHRQMASGLSMPVGFKNATDGRLQVAIDAIRSAMHQHSFLGIDQDGHSSVITTKGNPFGHLVLRGGSSKPNYDADSIAHAEKQLRKADLTPHLLVDCSHANSGKKCGNQLKVWADILAQKEQGNTSIVGVMIESNIFSGNQPFPVDPRELQYGVSITDECVSWEETERMLRDGAAFMKQVRSKA

SEQ ID NO: 1113 - DNA, 1077 bp, Yersinia pestis KIM
  CDS (1)..(1077): transl_table=11
atgatcatgcaaaaagactcgctcaataacgtccatatcagtgccgaacaaatcctgataaccccggaagaactgaaaaatcagtttccactgagcgaaaatgatcagtattcgatagagcgcgcacgtaaaaccattgctgacattattcaggggcgagatccgcgtctgttggtcgtttgtgggccctgttcaattcatgatgtggatgcggcactggattacgcgcgtcgtttgaaaaaactctctgtggaattggatgacagcttatatatcgttatgcgtgtctattttgagaagccaagaactaccgtgggttggaaaggcctgatcaatgaccctgcaatggatggttcatttgatgtagaggcaggtttacacattgcccgtcgtttattgctggatttagtgggcatggggttgccgttagcgactgaagctctggatcctaatagcccacaatatttaggtgacctgttcagttggtcggccattggtgcccgtacaacggagtcacagacccaccgtgaaatggcatcaggcttgtctatgccggttggatttaaaaatggcactgacggtagcctaggcacggcaatcaatgcaatgcgcgccgctgccatgccacatcgctttatggggatcaatcagtcgggccaggtctgcctgttacaaactcagggtaacccacacggccatgtcattctacggggaggtaaaacaccaaactacagtgcacaagatgtcgctcagtgtgaaaaacagatgcaggatgcgggactcatcccatccttaatgatagattgcagtcacggtaattcaaataaagactaccgccgtcaggttgcggtggctgaatctgtggttgaacagatcaaggcgggcaatcgttcaattacaggtgtgatgctggaaagccacatccacgaaggaaatcagtcatctgaacagccacgtgctgatatgcgctacggtgtttctgtgactgacgcctgtattaactgggaaagcactgaaaccctgttacgtggtatgcgccaagaattgcttgcagcactgacggcacggactgcatga

SEQ ID NO: 1114 - protein, 358 aa, Yersinia pestis KIM
MIMQKDSLNNVHISAEQILITPEELKNQFPLSENDQYSIERARKTIADIIQGRDPRLLVVCGPCSIHDVDAALDYARRLKKLSVELDDSLYIVMRVYFEKPRTTVGWKGLINDPAMDGSFDVEAGLHIARRLLLDLVGMGLPLATEALDPNSPQYLGDLFSWSAIGARTTESQTHREMASGLSMPVGFKNGTDGSLGTAINAMRAAAMPHRFMGINQSGQVCLLQTQGNPHGHVILRGGKTPNYSAQDVAQCEKQMQDAGLIPSLMIDCSHGNSNKDYRRQVAVAESVVEQIKAGNRSITGVMLESHIHEGNQSSEQPRADMRYGVSVTDACINWESTETLLRGMRQELLAALTARTA

SEQ ID NO: 1115 - DNA, 1047 bp, Yersinia pestis KIM
  CDS (1)..(1047): transl_table=11
atgtacaagatagatgaactgcggaccgctcgcatcgatagcttgattacaccgcagcaactggctgaaaagttaccgatttctgaggttattgcagataacgtgacggcgtcacgtaaacgaatagagaaaatacttattggtgaagacccacgtctactcgtggtgattggcccctgctctattcacgaccttgatgcagccgttgattatgccacccggctcaaggtgctacgagaacgctatcaagaccggctggaaatcgtgatgcgcacctatttcgagaaaccacggactgtagtgggttggaaggggctgatttctgatccggcacttgacggctcatgccaggtgaacttgggtattgaactggcacgtaagctactgttagccgtgaatgaactcgggctgccgaccgctaccgagttcctcaatatggtaacaggccaatatattgccgacctcatcagttggggggcaataggcgcacgtaccaccgaaagccagatccaccgagagatggcctcggcactctcctgccccgtgggtttcaaaaatggtacagatggcaatgtgcgtattgctattgatgccattcgcgccgcacaagccagccatatgttcctttctccggataaaaccggccaaatgacgatttaccaaaccagtggtaacccctatgggcatattattatgcggggtggaaagcaacctaactatgatgcctctgatatcgcagccgcctgtgacagcttgcgggaatttgatttgccagaacatctggtggtagattttagccacggcaattgccagaagatgcatcgccgccagttggatgttgccgaaaatatcgggctacagatccgtgcgggttcaacagcgattgtcggtgttatggctgagagtttcctgattgagggcacacagaagattgttgccggacagcccttaacttatgggcaatccatcactgacccttgcctgaattgggatgatactgaacaactgttaagcctattggcagatgcagtagacagccggttttaa

SEQ ID NO: 1116 - protein, 348 aa, Yersinia pestis KIM
MYKIDELRTARIDSLITPQQLAEKLPISEVIADNVTASRKRIEKILIGEDPRLLVVIGPCSIHDLDAAVDYATRLKVLRERYQDRLEIVMRTYFEKPRTVVGWKGLISDPALDGSCQVNLGIELARKLLLAVNELGLPTATEFLNMVTGQYIADLISWGAIGARTTESQIHREMASALSCPVGFKNGTDGNVRIAIDAIRAAQASHMFLSPDKTGQMTIYQTSGNPYGHIIMRGGKQPNYDASDIAAACDSLREFDLPEHLVVDFSHGNCQKMHRRQLDVAENIGLQIRAGSTAIVGVMAESFLIEGTQKIVAGQPLTYGQSITDPCLNWDDTEQLLSLLADAVDSRF

SEQ ID NO: 1117 - DNA, 1053 bp, Yersinia pestis KIM
  CDS (1)..(1053): transl_table=11
atgaattaccagaatgatgatttacggattaaagaaattaaggaactcctacctcctgttgcgttgttagagaaatttccctccacagttaatgcggcagaaaccgtcgccaagacccggaatgctattcacaacatcttgcgtgctcaggatgatcgcttgctggtggtgattggcccatgctctattcatgatacgcaagcggctaaagaatatgcggcccgtttgctggcactgcgtgaagaactgcagggcgagctggaagttgtcatgcgtgtttattttgaaaagccgcgtacaacggtgggttggaaaggcctgattaacgatccgcatatggacaatagctacgacatcaatgaaggtttacgtctggcgcgtgaattactcgtcgaaattaacgacagcgggttaccggccgccggtgagtttttggatatgattacgccgcagtatctggctgatctgatgagctggggagccattggcgcacgtactactgaatctcaggttcaccgcgaactggcttctggtctgtcttgccccgttggttttaaaaatggtaccgacggcaccattaaagtggctattgatgcgatcaacgcggccagtgccccacactgtttcttgtcggtgaccaaatggggtcattcggcgattgtgaatactgccggcaatggtgattgccatatcattttacgtggtggtaaagagccgaattacagcagtaagcatgtgaatgcggttaaagaagggctgattaaagcgggcctggaaccccagattatgatcgatttcagccacgctaacagttgcaaacagtttcaaaagcagatggaagtgggaacggatgtttgccaacaaattgcgcaaggtgaaaaatctatcataggcgtgatgatcgaaagccatttagtcgaaggtagccaaaacctggaaagtggtgaaccactaacctatggccagagtattaccgatgcctgtattggctggaaagatactgaggcgctgttgcgccagttggctggagcagtgagagctcgccgccagtag

SEQ ID NO: 1118 - protein, 350 aa, Yersinia pestis KIM
MNYQNDDLRIKEIKELLPPVALLEKFPSTVNAAETVAKTRNAIHNILRAQDDRLLVVIGPCSIHDTQAAKEYAARLLALREELQGELEVVMRVYFEKPRTTVGWKGLINDPHMDNSYDINEGLRLARELLVEINDSGLPAAGEFLDMITPQYLADLMSWGAIGARTTESQVHRELASGLSCPVGFKNGTDGTIKVAIDAINAASAPHCFLSVTKWGHSAIVNTAGNGDCHIILRGGKEPNYSSKHVNAVKEGLIKAGLEPQIMIDFSHANSCKQFQKQMEVGTDVCQQIAQGEKSIIGVMIESHLVEGSQNLESGEPLTYGQSITDACIGWKDTEALLRQLAGAVRARRQ

SEQ ID NO: 1119 - DNA, 1062 bp, Thermosynechococcus elongatus BP-1
  CDS (1)..(1062): transl_table=11
atgccgcaaacctttgatcttcacgttgttgagacacgacccttgttgacgcctgctaccctgctggcggatttaccgctgactgaatcccaagctacccttgtggccacaactcgcgatcgcattcgtgagattttcaaggggcgcgatcgccgcctgctggtgattgtggggccttgttcaattcacgatgtcaaggcagcgctggaatatggggaaaagttggcccggatacgcgatcgcctgcgggatagtctcgaaattgtgatgcgggtttactttgaaaaaccacggacctctgtaggttggaaaggcctcatcaacgatccgcacctcgatggcagctatgatatcaacaccgggctacgccttgcccgcaagctactgctggatttggccaacttaggaatacccgccgctacagaattactcgatccgatcattccccagtacattgccgatgttgtcagttggactgctattggcgctcgcaccaccgaaagccaaactcaccgtcaaatggcctcgggtctctcgatgcccgtaggcttcaaaaatggcaccgatggtcacttagattctgccattaatgccatgattgcggcccagcagtcccaccattttttgggcattaatgctgaaggccgcgccagtattgttgccaccactgggaatcccgatactcacctggtgctacggggcggcaaagacggccccaactattctgccgcccacattgagatggctgccgcactcttagagcgtaagggactcacaccacggctcatggtggattgtagtcatgccaacgctgccaaagacccccaacgccaagtgctagtgtgtgagaacctcgcccatcaggtccagcaaggctcccgttatttggcgggtgtgatgatcgaaagtcatctcaaggcgggtaatcaaccaattcccaaggatctctcgcagttggtctatggccaaagtattaccgatccctgcgtggactttgcaacaacagtaacaatgctcgaacaattggctagtgcggtaggatcgcaactggtggccagataa

SEQ ID NO: 1120 - protein, 353 aa, Thermosynechococcus elongatus BP-1
MPQTFDLHVVETRPLLTPATLLADLPLTESQATLVATTRDRIREIFKGRDRRLLVIVGPCSIHDVKAALEYGEKLARIRDRLRDSLEIVMRVYFEKPRTSVGWKGLINDPHLDGSYDINTGLRLARKLLLDLANLGIPAATELLDPIIPQYIADVVSWTAIGARTTESQTHRQMASGLSMPVGFKNGTDGHLDSAINAMIAAQQSHHFLGINAEGRASIVATTGNPDTHLVLRGGKDGPNYSAAHIEMAAALLERKGLTPRLMVDCSHANAAKDPQRQVLVCENLAHQVQQGSRYLAGVMIESHLKAGNQPIPKDLSQLVYGQSITDPCVDFATTVTMLEQLASAVGSQLVAR

SEQ ID NO: 1121 - DNA, 1008 bp, Streptococcus agalactiae 2603V/R
  CDS (1)..(1008): transl_table=11
atgggatttcatcagttaagtgataaaattaatattgaaatattgaagcagaaaactagcttagatctagaagttagccaaaaaaaattagccaaagaagaagagttaaaaaatatcataaaaggtgaggatcagcggtttctagtaatagtaggtccttgttctgcggataatccaaaggcggtgctaacttatgcaaagcgtttagctaaattggaagctgcctttaaagataaaatgtttttggttatgagagtttataccgctaagccaagaacgaatggtgatggttataaaggcttagttcaccattctgacaaactaggagttttttttcaagcacgtaagatgcactatgacatcattcgagagactggactcctgacagctgatgaattactttatccagagatgttatcagtgatggatgatttagtttcttactatgctattggtgcgcgttcagtggaagatcagggacaccgttttatatcttcaggtatagatgcaccagtaggtatgaaaaatccaacgtctggtaatttaagagtcatgtttaatgcggtctatgcagcacaaaatcaacaggaattattctatcaaaataagcaagttagaacagatggtaatttgctgtcacatgttattttgagaggatatcataatgccgactatcgaagtatccctaattatcattatgaaaaccttttagaaactattactcattatgaagagactgatttgcaaaatccctttattgttgttgatacaaatcatgacaattcaggtaagcaatttttagaacaaattcgcattgtgaaatcagtacttgcagaccgacagtggcatactaaaattagaaactatgttcgtggttttttgatagaatcttatttagaagatggaagacaagataaaccagatgtttttggtaagtctatcacagatccatgtctaggttgggataaaacagaaatgctaattagggatatttacaatagtttgtaa

SEQ ID NO: 1122 - protein, 335 aa, Streptococcus agalactiae 2603V/R
MGFHQLSDKINIEILKQKTSLDLEVSQKKLAKEEELKNIIKGEDQRFLVIVGPCSADNPKAVLTYAKRLAKLEAAFKDKMFLVMRVYTAKPRTNGDGYKGLVHHSDKLGVFFQARKMHYDIIRETGLLTADELLYPEMLSVMDDLVSYYAIGARSVEDQGHRFISSGIDAPVGMKNPTSGNLRVMFNAVYAAQNQQELFYQNKQVRTDGNLLSHVILRGYHNADYRSIPNYHYENLLETITHYEETDLQNPFIVVDTNHDNSGKQFLEQIRIVKSVLADRQWHTKIRNYVRGFLIESYLEDGRQDKPDVFGKSITDPCLGWDKTEMLIRDIYNSL

SEQ ID NO: 1123 - DNA, 1233 bp, Bifidobacterium longum NCC2705
  CDS (1)..(1233): transl_table=11
atgcagcagcaggaggaagcagcacattcgctgcatccgttgcaagtcggtccgcagccgttgaacaccccagaagagcttcgcgccattcgtcaggcgatgggggaggggaagaacccgctcgttgccactgatgtgccgcgttgggaagatcaggtgggtgtcagtcgcatcatcaaccgccgcgtattggagttggagccgctgcccacgcccgcgcaagtgctcgctgaactcccgctgactgatcaggctcaggaaatcgtcgcctactcgcgtgatgagattcgcgcgtgcctgtacggccaagacgacaggctgttggtcatcgtcggcccctgttcggttcatgacccgaaggccgcgctggactacgcgcgccgattggccaagctgaaagatgagctcggtgaacagctgctcatcgtcatgcgcgtgtacttcgagaagccgcgcactaccattggctggaagggcctgatcaacgacccggatattgatggcagccacaatattcgcaagggcctgttgcttgctcgcaaaaccttgcttggtgtgctgaaggaaggattggcggccgccacggaatttctggagcccaccagcccgcagttcatctcggacgcggtgagttggggcgccattggtgcgcgcaacacggaaagccagatccaccgccaattggccagcgggctttccatgccggtcggctttaagaatgccactgacggctcggtgaaggcagcggtcaacggttgcttcgccgctgctcagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgccgaatccgcagcctcgcatggtctgattgttgattgctcgcacggtaactccggcaaggacgaacatcgtcaggccgaagtcgtgcgcaatattgccagcagaattgcagctggcgaacagggtattaccggcatcatgatggaaagctttattgaaggaggcaatcagaaggccgcgccgcttgatcagctggtctatggcaagtcgattactgacaagtgcatcagctgggaagaaaccgaggccttgctgcgcgagcttgcggaagccgtagccacacggcgttggcactga

SEQ ID NO: 1124 - protein, 410 aa, Bifidobacterium longum NCC2705
MQQQEEAAHSLHPLQVGPQPLNTPEELRAIRQAMGEGKNPLVATDVPRWEDQVGVSRIINRRVLELEPLPTPAQVLAELPLTDQAQEIVAYSRDEIRACLYGQDDRLLVIVGPCSVHDPKAALDYARRLAKLKDELGEQLLIVMRVYFEKPRTTIGWKGLINDPDIDGSHNIRKGLLLARKTLLGVLKEGLAAATEFLEPTSPQFISDAVSWGAIGARNTESQIHRQLASGLSMPVGFKNATDGSVKAAVNGCFAAAQQHTFFGIDHLGRACAVETLGNPDCHVVLRGSIHGPNYDAESVAKAMEDVRAEMPAESAASHGLIVDCSHGNSGKDEHRQAEVVRNIASRIAAGEQGITGIMMESFIEGGNQKAAPLDQLVYGKSITDKCISWEETEALLRELAEAVATRRWH

SEQ ID NO: 1125 - DNA, 1134 bp, Bifidobacterium longum NCC2705
  CDS (1)..(1134): transl_table=11
atggcagcactacgtggtccggatagttccgaggatgaacgtcgtttgggggagcaggccgtctttcctgagaccgtcgatgtcaacattcgtcagcttgaccccattcccgcgccgcgtgctttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagttggaagaccgactcgtgatcgtgatgcgcgtgtacttcgagaagccgcgcaccaccatcggctggaaaggcctcatcaacgaccccgatctggacggtcgcttcaatattcgtaagggcatgtggctggcccgcaaggtgctcaccgacgtgctgagcctcggtctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgtttcgcggccggcttcgagcatcacttcctgtccattaacttggacggtcgcgtgatttccgccgaaaccaaaggcaacccggattgccatctggttctgcgcggctccagccacggcccgaactacgatgccgaatccgtgcgtcaagctctggaagacctcaaggtttccaaagcgtccggcccgagccagcatggcctcgtcatcgatgccgcccacggcaactgcggcaaagacgaaaaccgcgaagccgaagtcatcgaagagatcgctgagcgcctggcgcacggcgaacaaggcatcaccggcgtaatgatggaaagcttcttggtcggcggtcaccaaaagccggccccgctcgaccagttggtctacggtcagtccgtcaccgactcttgcgtgccgtgggaacgcaccaacgaactgctgcacaccctagccgacgccgtcaccgctcgccgctcggctaaatag

SEQ ID NO: 1126 - protein, 377 aa, Bifidobacterium longum NCC2705
MAALRGPDSSEDERRLGEQAVFPETVDVNIRQLDPIPAPRAFLREQPLTDEMSELVLHSRQEIRDVLNGRDDRLLVIVGPCSIHDPKAAHEYAEKLAAVKRELEDRLVIVMRVYFEKPRTTIGWKGLINDPDLDGRFNIRKGMWLARKVLTDVLSLGLPAATEWLDPITPQYICDAISWGAIGARNTESQVHRELASGLSMPVGFKNSTDGSIKAAADSCFAAGFEHHFLSINLDGRVISAETKGNPDCHLVLRGSSHGPNYDAESVRQALEDLKVSKASGPSQHGLVIDAAHGNCGKDENREAEVIEEIAERLAHGEQGITGVMMESFLVGGHQKPAPLDQLVYGQSVTDSCVPWERTNELLHTLADAVTARRSAK

SEQ ID NO: 1127 - DNA, 1071 bp, Shigella flexneri 2a str. 301
  CDS (1)..(1071): transl_table=11
atgcataaagacgcgctgaataacgtacatattaccgacgaacaggttttaatgactccggaacaactgaaggccgcttttccattgagcctgcaacaagaagcccagattgctgactcgcgtaaaaccatttcagatattatcgccgggcgcgatcctcgtctgctggtagtatgtggtccttgttccattcatgatccggaaactgctctggaatatgctcgtcgatttaaagctcttgccgcagaggtcagcgatagcctctatctggtaatgcgcgtctattttgaaaaaccccgtaccactgtcggctggaaagggttaattaacgatccccatatggatggctcttttgatgtagaagccgggctgcaaatcgcgcgtaaattgttgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgacggcagtctggcaacagcaattaacgctatgcgcgccgccgcccagccgcactgttttgttggcattaaccaggcagggcaggttgcgttgctacaaactcaggggaatccggacgggcatgtgatcctgcgcggtggtaaagcgccgaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggtaatcgctcaattattggtctgatgatcgaaagtaatatccacgagggcaatcagtcttctgagcaaccgcgcagtgaaatgaaatacggtgtatccgtaaccgatgcctgcattagctgggaaatgactgatgccttgctgcgtgaaattcatcaggatctgaacgggcagctgacggctcgcgtggcttaa

SEQ ID NO: 1128 - protein, 356 aa, Shigella flexneri 2a str. 301
MHKDALNNVHITDEQVLMTPEQLKAAFPLSLQQEAQIADSRKTISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHCFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 1129 - DNA, 1059 bp, Shewanella oneidensis MR-1
  CDS (1)..(1059): transl_table=11
atgtattaccaaaatgatgacgttcgcattaatgaagttaaagagttacttccccctattgcgatcctagaacgatttcctgcctccgaaaacgctgctgcaactgtgtttaatgcccgtcaaagcatccataatattctcgctcgtgaagatgatcgcctattagtggtcattggtccctgctctattcatgatcctaaagcggcgctggaatacggtcagcgattggttgtccttagagagcgctatcaagatcaacttgagattgtgatgcgagtgtattttgaaaagccgcgaactaccgtagggtggaaggggctgatcaatgatccttacatggataacagtttcaaactgaatgatggtttgcgaacagcgcgtaaactcttggtcgatttgaatgattcaggcatgccgacagcgggtgagttcctcgacatgattactccgcaatatgtggcggatatgatgtgttggggcgccattggtgcccgcacaacagaatcacaagtccaccgcgaactggcctcgggtttatcttgtcctgtgggctttaaaaatggcacagacggcacaatcaaagtggcaatcgatgccattggtgccgctaatgcgccgcatcactttttatctgtgaccaaatttggccattcggcgattgtctccactaaaggcaacccagattgccatatcatccttcgcggcggccgagagccgaattacagtgcgagccacgtcgcccaaatcagtgaccaactgaaaaaagccaaactggtcgacaacatcatgatcgactttagccatgccaatagcagcaaacaatatcagcggcaaatggtggtggccaatgaggttgccgaacaagtcgcggcgggcaatcaggcgatttttggggtgatggttgaaagccacttagtcgaagggcgccaagatctgatcgagggccaagcgttatgctacggccagagtgtgactgatgcttgtattggttgggaagattctgagcgtttgttagctgtgctaaatcagagtgttgttgagcgacgtcagcgggtttaa

SEQ ID NO: 1130 - protein, 352 aa, Shewanella oneidensis MR-1
MYYQNDDVRINEVKELLPPIAILERFPASENAAATVFNARQSIHNILAREDDRLLVVIGPCSIHDPKAALEYGQRLVVLRERYQDQLEIVMRVYFEKPRTTVGWKGLINDPYMDNSFKLNDGLRTARKLLVDLNDSGMPTAGEFLDMITPQYVADMMCWGAIGARTTESQVHRELASGLSCPVGFKNGTDGTIKVAIDAIGAANAPHHFLSVTKFGHSAIVSTKGNPDCHIILRGGREPNYSASHVAQISDQLKKAKLVDNIMIDFSHANSSKQYQRQMVVANEVAEQVAAGNQAIFGVMVESHLVEGRQDLIEGQALCYGQSVTDACIGWEDSERLLAVLNQSVVERRQRV

SEQ ID NO: 1131 - DNA, 1092 bp, Shewanella oneidensis MR-1
  CDS (1)..(1092): transl_table=11
atgcagcaggatacaattaataacgtccatatcagttcagagaatgttcttattaccccgcaggagctcaaagcggctctaccactctctgagcatgcatatcgttatatcctcaatgcacgcaaaactgtggcggatatcgtccataagcgcgataaccgcgtgctcatcatcactggaccttgttcgattcatgatatcgatgccgccaaagaatacgctttaaaactcaaaaaattacacgatgaacttagtgatgaattttacatcctgatgcgggtgtactttgagaagccacgtaccacagtgggttggaaggggatgattaacgaccccgatatggatggctcttttgatgtggaaaagggcttaaagctggcccgtgagttgatgatttggctggcggaacttgagctgcctgttgcaaccgaagcactcgaccctatcagccctcagtacatttctgagctagtgacttggtcggccataggtgcccgcaccaccgaatcgcaaacccatagggaaatggcgtcgggcttatctatgcccgttggctttaaaaatggtacagatggtaagctcgatgtggcaatcaatgccctcaaatcggcagccagtagccacagatttatggggatcaaccaacagggtcaagtggcgctgttgcaaaccgcgggcaacccagatggtcatgtgattttacgtggtggcgtaacacctaactacgatgcggccagtgtggctgaatgtgaggcgcagcttcataaggccaaactcaatgcccgtcttattatcgattgtagccatggcaactcctctaaggattacgcaaggcaagtccctgtgtgtgaagatgtatttgcgcagatctacaatggtaacaagtccattattggcgtgatgttagagagccatttaaacgaaggtaatcaaagttgtgataaaccatcaggcgaactggcctatggggtttcggtaacagactcctgtattaattgggaaaaaaccgaaagcgttttacgtgcgggcgcatcgaagttatcttcagtgttaccaactcgtttcgatttgcgtaaagtggccaatgcttaa

SEQ ID NO: 1132 - protein, 363 aa, Shewanella oneidensis MR-1
MQQDTINNVHISSENVLITPQELKAALPLSEHAYRYILNARKTVADIVHKRDNRVLIITGPCSIHDIDAAKEYALKLKKLHDELSDEFYILMRVYFEKPRTTVGWKGMINDPDMDGSFDVEKGLKLARELMIWLAELELPVATEALDPISPQYISELVTWSAIGARTTESQTHREMASGLSMPVGFKNGTDGKLDVAINALKSAASSHRFMGINQQGQVALLQTAGNPDGHVILRGGVTPNYDAASVAECEAQLHKAKLNARLIIDCSHGNSSKDYARQVPVCEDVFAQIYNGNKSIIGVMLESHLNEGNQSCDKPSGELAYGVSVTDSCINWEKTESVLRAGASKLSSVLPTRFDLRKVANA

SEQ ID NO: 1133 - DNA, 1065 bp, Shewanella oneidensis MR-1
  CDS (1)..(1065): transl_table=11
atgaccattaaaacagacgaattacgcacttccttattagctaaagtcatctcacctgcacaactggcatctgagtaccccttaacccaagatgctgccgactacctcgttcaacaacgtcgtgaagttgaagccatcattatgggcgaagaccaacgcctgttggtgatcattggcccttgctctatccacgatacgcaagccgccctcgattacgcccgccgcttagcagtgctacatcaagagttaaaggacgacctctgtattttaatgcgagtgtattttgaaaagccgcgcacgattgtgggttggaaggggttgatttccgatcctgacttagatggcagcttcgagccaaataaaggattgcgtattgcacgccagcttctacagcaaatcactgagcttaagctgcccatcgctaccgaatttttagatatggtgaacgggcaatatattgccgatttaatcacctggggcgcgattggtgctcgcaccaccgaaagccaagtacaccgtgaaatggcctcagccctttcttgccctgtgggctttaaaaacggaaccgatggcaatattaatatcgccgttgatgcggtacgtgccgcaaaagtgccgcatatcttctactcaccggataaagatggtgcgatgtctgtctatcgcacccatggtaatccttacggacacatcattttacgtggcggtaaaaaacccaattactttgagcaagacattgaacaagcaagattaaaacttgagtctgtcaatgttacaccgcgtgtggtggttgattttagccacggaaatagtgaaaaaaatcacctaaaacaactggtcgttgctgaaaatatcatggcgcaaatgcgtgctggtagtacggccattgccggcatcatggccgaaagtttcttacaagaaggcaaccaaaaggtgattgaaggtcaacccctatgttatggccaaagcatcacggatgcctgcttacattgggctgactccgaaaaattactgcgagatcttgccagcgcctcacgcgatagacgcgaactccttggcaaataa

SEQ ID NO: 1134 - protein, 354 aa, Shewanella oneidensis MR-1
MTIKTDELRTSLLAKVISPAQLASEYPLTQDAADYLVQQRREVEAIIMGEDQRLLVIIGPCSIHDTQAALDYARRLAVLHQELKDDLCILMRVYFEKPRTIVGWKGLISDPDLDGSFEPNKGLRIARQLLQQITELKLPIATEFLDMVNGQYIADLITWGAIGARTTESQVHREMASALSCPVGFKNGTDGNINIAVDAVRAAKVPHIFYSPDKDGAMSVYRTHGNPYGHIILRGGKKPNYFEQDIEQARLKLESVNVTPRVVVDFSHGNSEKNHLKQLVVAENIMAQMRAGSTAIAGIMAESFLQEGNQKVIEGQPLCYGQSITDACLHWADSEKLLRDLASASRDRRELLGK

SEQ ID NO: 1135 - DNA, 1035 bp, Streptococcus mutans UA159
  CDS (1)..(1035): transl_table=11
atgggtattcatcaaaaaagcaaaaccatagatcttttcacggttaaacaaggcacgcaattaaaaggtcaggatttggctaagaaagaagcacgtgatcgtgaattggtttccattatcaagggagaggacaaccgtttactcttgattattggtccttgttcatcagataatgaagaagctgttcttgagtatgctaaacgtcttgctaaattgcaggaagaagttaaagatcgcatctttatggtgatgcgtgtttatacggcaaagccacgtactaatggtgatggttataaaggcctcattcatcaaccaaatacttctaaattgccagatttgattaatggcattcatgctgttcgtaatttgcattatcgtgtgattactgagacaggattgacaacagcagatgaaatgctttacccttctaatcttgtcttagtagatgatttggtttcttatcatgctgttggtgctcgttcggttgaagatcaggaacatcgctttgtggcttcaggcattgatgtgcctactggcatgaaaaatccaacgtctggtaatctcaaggttatgcttaatgctttacatgcagcacaaaattcacaaaattttatctataatggagcagaagtagaaacagacggcaattccttggctcatgttattttgcgcggaggcagcaatgagcatggtgactatgaacctaattattattatgacgttctcttaaaactgatccaacagtatgaaaatatgaatttaatcaatccctttattgttgttgataccaatcatgataactctggcaaaaattatttggaacaagtaagaattgttcggcaaacccttattaaccgtgactggaatgataaaatcaataagtatgttcgcggctttatgattgaatcttatctagaagatggtcgtcaggataagccagaagtttttggcaagtctattacggatccttgtttgggttgggaaaatactcaacagttgatttatgagatttaccatactctcaaagcaaaataa

SEQ ID NO: 1136 - protein, 344 aa, Streptococcus mutans UA159
MGIHQKSKTIDLFTVKQGTQLKGQDLAKKEARDRELVSIIKGEDNRLLLIIGPCSSDNEEAVLEYAKRLAKLQEEVKDRIFMVMRVYTAKPRTNGDGYKGLIHQPNTSKLPDLINGIHAVRNLHYRVITETGLTTADEMLYPSNLVLVDDLVSYHAVGARSVEDQEHRFVASGIDVPTGMKNPTSGNLKVMLNALHAAQNSQNFIYNGAEVETDGNSLAHVILRGGSNEHGDYEPNYYYDVLLKLIQQYENMNLINPFIVVDTNHDNSGKNYLEQVRIVRQTLINRDWNDKINKYVRGFMIESYLEDGRQDKPEVFGKSITDPCLGWENTQQLIYEIYHTLKAK

SEQ ID NO: 1137 - DNA, 1032 bp, Streptococcus mutans UA159
  CDS (1)..(1032): transl_table=11
atgtcttttaaagcaactagtgataaaattaatatagaagaaatgcggagcttgtcaaaattaacaggtgaagctttagcccaaaaggaagcacgtgatcgtgaattggtttccattatcaagggagaggacaaccgtttactcttgattattggtccttgttcatcagataatgaagaagctgttcttgagtatgctaaacgtcttgctaaattgcaggaagaagttaaagatcgcatctttatggtgatgcgtgtttatacggcaaagccacgcactaatggtgatggctacaaaggaatggtccatcaacctaatacaggcgcggctcccagtctgattaacggtattacagctgtacgccatctgcattatcgtgtgattactgaaacgggtattacaacagcagatgaaatgctctatcctgaaaaccttcctttgattgatgatttagtatcctatattgcagttggtgcccgttcagttgaggatcaacaacaccgttttgtagcttcaggcattgatgtgcctactggcatgaaaaatccaacatcaggaaatcttaatatcatgtttaatggtatttatgctgcgcaaaataaacaatcgttccttttcaatggcgaagaagttgaaaccagcggcaatcctacagctcacgttatcttgcgaggcggcgttaatgaatatggaaaaaatattccaaattattactatgacaatgttttagatacgattgatcagtatgaaaagatggggctgcaaaatccttttattgttgttgataccaatcatgataactctggtaaaaactatttggaacaagtaagaattgttcggcaaacccttattaaccgtgactggaatgacaaaatcaataaatatgttcgcggctttatgattgaatcttatctggaagatggtcgtcagaatgagccagaagtttttggcaagtctattacggatccttgtttgggttgggaaaatactaaacaattggttcatgaaatttatgatactttaggaaattaa

SEQ ID NO: 1138 - protein, 343 aa, Streptococcus mutans UA159
MSFKATSDKINIEEMRSLSKLTGEALAQKEARDRELVSIIKGEDNRLLLIIGPCSSDNEEAVLEYAKRLAKLQEEVKDRIFMVMRVYTAKPRTNGDGYKGMVHQPNTGAAPSLINGITAVRHLHYRVITETGITTADEMLYPENLPLIDDLVSYIAVGARSVEDQQHRFVASGIDVPTGMKNPTSGNLNIMFNGIYAAQNKQSFLFNGEEVETSGNPTAHVILRGGVNEYGKNIPNYYYDNVLDTIDQYEKMGLQNPFIVVDTNHDNSGKNYLEQVRIVRQTLINRDWNDKINKYVRGFMIESYLEDGRQNEPEVFGKSITDPCLGWENTKQLVHEIYDTLGN

SEQ ID NO: 1139 - DNA, 1008 bp, Streptococcus agalactiae NEM316
  CDS (1)..(1008): transl_table=11
atgggatttcatcagttaagtgataaaattaatattgaaatattgaagcagaaaactagcttagatctagaagttagccaaaaaaaattagccaaagaagaagagttaaaaaatatcataaaaggtgaggatcagcggtttctagtaatagtaggtccttgttctgcggataatccaaaggcggtgctaacttatgcaaagcgtttagctaaattggaagctgcctttaaagataaaatgtttttggttatgagagtttataccgctaagccaagaacgaatggtgatggttataaaggcttagttcaccattctgacaaactaggagttttttttcaagcacgtaagatgcactatgacatcattcgagagactggactcctgacagctgatgaattactttatccagagatgttatcagtgatggatgatttagtttcttactatgctattggtgcgcgttcagtggaagatcagggacaccgttttatatcttcaggtatagatgcaccagtaggtatgaaaaatccaacgtctggtaatttaagagtcatgcttaatgcggtctatgcagcacaaaatcaacaggaattattctatcaaaataagcaagttagaacagatggtaatttgctgtcacatgttattttgagaggatatcataatgccgactatcgaagtatccctaattatcattatgaaaaccttttagaaactattactcattatgaagagactgatttgcaaaatccctttattgttgttgatacaaatcatgacaattcaggtaagcaatttttagaacaaattcgcattgtgaaatcagtacttgcagaccgacagtggcatactaaaattagaaactatgttcgtggttttttgatagaatcttatttagaagatggaagacaagataaaccagatgtttttggtaagtctatcacagatccatgtctaggttgggataaaacagaaatgctaattagggatatttacaatagtttgtaa

SEQ ID NO: 1140 - protein, 335 aa, Streptococcus agalactiae NEM316
MGFHQLSDKINIEILKQKTSLDLEVSQKKLAKEEELKNIIKGEDQRFLVIVGPCSADNPKAVLTYAKRLAKLEAAFKDKMFLVMRVYTAKPRTNGDGYKGLVHHSDKLGVFFQARKMHYDIIRETGLLTADELLYPEMLSVMDDLVSYYAIGARSVEDQGHRFISSGIDAPVGMKNPTSGNLRVMLNAVYAAQNQQELFYQNKQVRTDGNLLSHVILRGYHNADYRSIPNYHYENLLETITHYEETDLQNPFIVVDTNHDNSGKQFLEQIRIVKSVLADRQWHTKIRNYVRGFLIESYLEDGRQDKPDVFGKSITDPCLGWDKTEMLIRDIYNSL

SEQ ID NO: 1141 - DNA, 1170 bp, Corynebacterium efficiens YS-314
  CDS (1)..(1170): transl_table=11
ttgtttccccatatgatttcccccataaacggtttccacaccaccatcaccgcccgaaaggcagaccccagcaccatgagcgccccagtgtccctccccaacccggcatccaccagcaacaaacgggtggttgccttccatgagctgcccagcccggccgaactcaccgccgacaaccccctgagtccacgtcaggcggagaaggttgagcgcgaccgccaggagatcgccgatatcttcgccggcgatgatgaccgcctcgtggttgtggtcggcccgtgttcggtccatgacccggaggctgcgatcgactacgccaaccgcctggcgcccctggccaagcggctggaccaggacctgaagatcgtcatgcgtgtctacttcgagaagccacgcaccaccgtcgggtggaaggggctgatcaatgatccgcacctcaacgagacctacgacatcgccgagggactgcgcctggcacgcaaggtgcttatcgacgttgtgaacctcgacctgcccgtcggttgtgaattcctcgaaccgaacagcccgcagtactacgccgatgccgtggcctggggtgccatcggtgcacgcaccaccgaatcccaggtccaccgccagctcgcctccgggatgtccatgcccatcggtttcaagaacggcaccgacggcaatgtccaggttgccatcgatgcggtggaatccgcccggagcccccacttcttctttggcacctccgaccacggtgcaccctcggtggtgcagaccgcgggtaactccaacagccatatcatcctccgtggtggcaccaccggacccaaccacgatgcggcatccgtggcgcaggccgtggagaagctgggggagggggcacgtctcatgatcgatgcctcccacgccaactcaggcaaggaccatatccgtcaggtcggtgtggtccgtgagatcgccgagcagatcgccgctggtgatgaggccatcgccggcatcatgatcgagtccttcctcgtcggtggcgcccagaacctggatcctgccaggctgaagatcaacggcggtgaggggctggtctacggccagtccgtcaccgacaagtgcatcgacatcgacaccaccgtcgatctgctcggtgagctcgccgcggcggtccgtacccgccggcaggcctga

SEQ ID NO: 1142 - protein, 389 aa, Corynebacterium efficiens YS-314
MFPHMISPINGFHTTITARKADPSTMSAPVSLPNPASTSNKRVVAFHELPSPAELTADNPLSPRQAEKVERDRQEIADIFAGDDDRLVVVVGPCSVHDPEAAIDYANRLAPLAKRLDQDLKIVMRVYFEKPRTTVGWKGLINDPHLNETYDIAEGLRLARKVLIDVVNLDLPVGCEFLEPNSPQYYADAVAWGAIGARTTESQVHRQLASGMSMPIGFKNGTDGNVQVAIDAVESARSPHFFFGTSDHGAPSVVQTAGNSNSHIILRGGTTGPNHDAASVAQAVEKLGEGARLMIDASHANSGKDHIRQVGVVREIAEQIAAGDEAIAGIMIESFLVGGAQNLDPARLKINGGEGLVYGQSVTDKCIDIDTTVDLLGELAAAVRTRRQA

SEQ ID NO: 1143 - DNA, 1113 bp, Pseudomonas putida KT2440
  CDS (1)..(1113): transl_table=11
ttggcggccggcacccgtgacctgacgagtaacacgatggctgatttaccgatcgatgacttgaacgttgcctccaacgagaccctgatcacccctgatcagctcaagaaggaaatccccctcagcgccaaggccctgcagaccgtgactgccggccgtgaagtggtgcgcaatattctcgacggcaaggaccatcgcctgttcgtcgtggtcggcccttgctccatccacgacatcaaggcagcccacgaatacgccgagcgcctgaaagtgctggccgaagaagtgtccgatacgctgtacctggtcatgcgcgtgtacttcgaaaagccgcgcaccaccgtcggctggaaaggcctgatcaacgatccgtacctggatgactcgttcaagatccaggacggcctgcacatcggccgcaagttgctgctggacctggccgaaatgggcctgccgaccgccaccgaagcgctcgacccgatttcgccgcagtacctgcaagacctgatcagctggtcggccatcggtgcccgcaccaccgaatcgcaaacacaccgcgagatggcctcgggcctgtcctcggcggtgggtttcaagaacggtaccgatggcggcctgaccgttgccatcaatgccctgcagtcggtgtccaagccgcaccgcttcctgggcatcaaccaggaaggcggcgtgtcgatcgtcaccaccaagggcaacccatacggccacgtggtactgcgcggcggcaatggcaagccgaactacgactcggtcagcgtcgccctgtgcgaacaggacctggccaaggccaagatcaaggccaacatcatggtcgactgcagccatgccaactccaacaaggacccggccctgcaaccgctggtgatggagaacgtcgccaaccagattctcgaaggcaaccagtcgatcatcggcctgatggtcgaaagccacctgaactggggctgtcagtccattccgaaaaacctggacgatttgcagtatggcgtgtcgatcacggacgcctgcatcgactggtcggctaccgagaaaaccctgcgcagcatgcatgccaagctcaaggatgtgctgccgcagcgtaagcgcggctga

SEQ ID NO: 1144 - protein, 370 aa, Pseudomonas putida KT2440
MAAGTRDLTSNTMADLPIDDLNVASNETLITPDQLKKEIPLSAKALQTVTAGREVVRNILDGKDHRLFVVVGPCSIHDIKAAHEYAERLKVLAEEVSDTLYLVMRVYFEKPRTTVGWKGLINDPYLDDSFKIQDGLHIGRKLLLDLAEMGLPTATEALDPISPQYLQDLISWSAIGARTTESQTHREMASGLSSAVGFKNGTDGGLTVAINALQSVSKPHRFLGINQEGGVSIVTTKGNPYGHVVLRGGNGKPNYDSVSVALCEQDLAKAKIKANIMVDCSHANSNKDPALQPLVMENVANQILEGNQSIIGLMVESHLNWGCQSIPKNLDDLQYGVSITDACIDWSATEKTLRSMHAKLKDVLPQRKRG

SEQ ID NO: 1145 - DNA, 1062 bp, Pseudomonas putida KT2440
  CDS (1)..(1062): transl_table=11
atgcacgcttccagcctcgccctgcccctgacccagccgcaagcggccaacaccactgtcagcagacgcctgcccagcccgcacctgctcaagcagcagatgccactgcccagcgaactggcccagcaagtccaggcccatcgccaggccatccgcaacatcctcgaaggccgcgacccgcgcctgctggtcatcgtcggcccctgctcgattcatgacccacgctcggccctggaatacgccgaccgcctggccgcccttggccgcgaagtcaacgacaagctgctgctggtgatgcgcgcctacgtcgaaaaaccgcgtactacagtgggctggaaaggcctggcctacgacccgcacctcgatggcagtgacgacatgcactcgggtatcgccttgtctcgcgggctgatgctgagcatgatcgaacgcggcctgccgatcgctaccgagttgctgcaaccgatggccgccggttacttcgacgacctgttggcctgggcggcgatcggcgcacgcaccaccgaatcgcaaatccaccgcgaaatggtcagtggcctggagctgccggtcggcttcaagaacggtacggacggcggcatcgccatcgccagcgacgccatgcgcagcgctgcccacccgcaccgccacttcggtatggatgctcagggccacccggcgatcatcgagaccttgggcaacccggacacacaccttgtactgcgcggcggccacaaaggcccgaaccatgatgccaacagcatcgccatggcccgccaggcgttggccaaggccggtctgcaggcacggatcatggtcgattgcagccacgccaacagcggcaaggacccggcgcgccagccagcggtcttcaatgatgtgctggaacagcgcctggccggcgaccgttcgttggtcggcgtcatgatcgaagggcacttgttcgatggctgccaggcgttgggcaagggcacactgaaatacggtgtgtcgattaccgacggctgcctgggctgggcctcgaccgaaaccctgttgcgtgaggcggcacaaaaactgtag

SEQ ID NO: 1146 - protein, 353 aa, Pseudomonas putida KT2440
MHASSLALPLTQPQAANTTVSRRLPSPHLLKQQMPLPSELAQQVQAHRQAIRNILEGRDPRLLVIVGPCSIHDPRSALEYADRLAALGREVNDKLLLVMRAYVEKPRTTVGWKGLAYDPHLDGSDDMHSGIALSRGLMLSMIERGLPIATELLQPMAAGYFDDLLAWAAIGARTTESQIHREMVSGLELPVGFKNGTDGGIAIASDAMRSAAHPHRHFGMDAQGHPAIIETLGNPDTHLVLRGGHKGPNHDANSIAMARQALAKAGLQARIMVDCSHANSGKDPARQPAVFNDVLEQRLAGDRSLVGVMIEGHLFDGCQALGKGTLKYGVSITDGCLGWASTETLLREAAQKL

SEQ ID NO: 1147 - DNA, 1077 bp, Escherichia coli CFT073
  CDS (1)..(1077): transl_table=11
gtgtgcaatagatggttaagaatagaactttcaggagatacaatgcagtcagtcagtaaatcaatctaccgagggaagttgcttagcagtttacctgctgtgggcgagattcataaagaaatcgcagtatcagaagaaaccgtaacatggatctctctgcaacgagagattatagcgaatattttgctgggaaaagatcctcgcttgcttgtgattgttggtccatgctcaatccatgacgttcaggctgccgttgaatatgcgaaacgattgtccgtattacagaataagtacttatcgcaaatgtacattgtaatgcgcacttattttgagaaacctcgaactcgtaaaggctggaaaggaataatgcacgatcctgatctaaatggaagctataatgttgagaaagggatacgatatgctcgccagtgtttgtcctcaatcacaacaatgcgtgtcgcaaccgctacagaattcctcgatcctttccttactccctatattgctgatttaatatgttggggggctgttggtgccagaactactgaatcacaaacgcatcgtcaacttgcgtctggtttacattgtcctgttggatttaaaaacagcactgatggaaatattaacttagctattgatgctattcttgcagcccgtgaacaacatgttgtatatatgacatctttaacaaaatgtatatctaccctattaaccgatggcaatccacatggacatctcatattacgtggtggtagagagccgaactatggtttgtcggatataacgaaggcagtgaaattaatgcatgatgaaggtatcaatcatcgtctgataattgactgtagccatggtaatagtggtaaagtggctgaacggcaaatctctgttgctcgtgaagtcattgataatcggaaaaagatgccgggatatgtagctggaattatgctggaaagctttttacaaggtggaaaacaatcagacagccttccgcgagagtatggtcagtctgttactgatgagtgtctttcatggcaacagacagaacaattattatcaactctggcagcacaactttaa

SEQ ID NO: 1148 - protein, 358 aa, Escherichia coli CFT073
MCNRWLRIELSGDTMQSVSKSIYRGKLLSSLPAVGEIHKEIAVSEETVTWISLQREIIANILLGKDPRLLVIVGPCSIHDVQAAVEYAKRLSVLQNKYLSQMYIVMRTYFEKPRTRKGWKGIMHDPDLNGSYNVEKGIRYARQCLSSITTMRVATATEFLDPFLTPYIADLICWGAVGARTTESQTHRQLASGLHCPVGFKNSTDGNINLAIDAILAAREQHVVYMTSLTKCISTLLTDGNPHGHLILRGGREPNYGLSDITKAVKLMHDEGINHRLIIDCSHGNSGKVAERQISVAREVIDNRKKMPGYVAGIMLESFLQGGKQSDSLPREYGQSVTDECLSWQQTEQLLSTLAAQL

SEQ ID NO: 1149 - DNA, 1140 bp, Escherichia coli CFT073
  CDS (1)..(1140): transl_table=11
atgtgttatcgttacgtcatcctcgctgaggatcaactatcgcaaacgagcataaacaggatcgccatcatgcagaaagacgcgctgaataacgtacatattaccgacgaacaggttttaatgactccggaacaactgaaggccgcttttccattaagcctgcaacaagaagcccagattgctgactcgcgtaaaaccatttcagatattatcgccgggcgcgatcctcgtctgctggtagtatgtggtccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgatggcagtctggcaacggcaattaacgctatgcgtgccgccgcccagccgcaccgttttgttggcattaaccaggcagggcaggttgcgttgctacaaactcaggggaatccggacgggcatgtgatcctgcgcggtggtaaagcgccaaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaa

SEQ ID NO: 1150 - protein, 379 aa, Escherichia coli CFT073
MCYRYVILAEDQLSQTSINRIAIMQKDALNNVHITDEQVLMTPEQLKAAFPLSLQQEAQIADSRKTISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHRFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 1151 - DNA, 1071 bp, Vibrio vulnificus CMCP6
  CDS (1)..(1071): transl_table=11
atgcagaaaagtgaactaagcaatattaatatcagcgatgaacaagtgctgattacgccagaacagctaaaacagaaactgccactgagcgacaacgcccgccgcttcattcaagagtcgcgtaataccgtcgccaatattattcataagcaagatcatcgtctgctggtggtttgtggtccttgttctattcacgatctggacgcggcaaaggattacgcgcgtcgcctaaaagcgctctccgccgagttaagcgatcaactgtatattgtgatgcgtgtttactttgaaaaacctcgtactactgtgggttggaaagggctcatcaacgaccctcatctggatggtagcttcgatattgagcatggtctgcatgttggccgtcaattgctggtggagctggctgaaatggagatccctctggcgacagaagcactcgacccaattagcccgcaatacttggctgatacattcagttgggctgcgattggtgcgcgtacgacagaatcacaaactcaccgtgaaatggccagtggtttgtctatgccgattggttttaaaaatggcacggatggcagcttgtcaacggcgatcaacgcaatgcaagcggcctcttcaagccaccgttttatggggatcaaccgtgaaggccaagtggcattgctgacgactcaaggtaacccaaatggtcacgtgattttgcgtggtggtaagcagaccaactacgattctgtgtcggtggcggagtgtgagcaagacatggccaaagtgggtttagatgcgtcattgatggtggattgtagccatgccaattcacgcaaagattaccgtcgtcagcctttagtcgccgaagacgtgattcatcaaattcgcgaaggcaacaaatcgatcattggtttgatgattgaaagccacattaatgaaggtaatcaatcctcagatttaccgctttctgagatgcggtacggtgtttctattaccgatgcctgtatcaattggcaggcaactgaggcactattgcgtaaagcacacaaagagttagtgccacatttagaaaaccgtctcaaataa

SEQ ID NO: 1152 - protein, 356 aa, Vibrio vulnificus CMCP6
MQKSELSNINISDEQVLITPEQLKQKLPLSDNARRFIQESRNTVANIIHKQDHRLLVVCGPCSIHDLDAAKDYARRLKALSAELSDQLYIVMRVYFEKPRTTVGWKGLINDPHLDGSFDIEHGLHVGRQLLVELAEMEIPLATEALDPISPQYLADTFSWAAIGARTTESQTHREMASGLSMPIGFKNGTDGSLSTAINAMQAASSSHRFMGINREGQVALLTTQGNPNGHVILRGGKQTNYDSVSVAECEQDMAKVGLDASLMVDCSHANSRKDYRRQPLVAEDVIHQIREGNKSIIGLMIESHINEGNQSSDLPLSEMRYGVSITDACINWQATEALLRKAHKELVPHLENRLK

SEQ ID NO: 1153 - DNA, 1053 bp, Vibrio vulnificus CMCP6
  CDS (1)..(1053): transl_table=11
atgccactaaaaacagatgaattgagaacccaacctttgggtccaatgccaactcccgctgagttgagccaagcccatccgattaccgacgatgtggccgagcgaattgcgaaatctcgcagacaaattgaagatattttaacgggtaaggacaaccgccttttggtgattgtcggtccttgctctgtgcacgatactgaagccgcgattgattacgcgacgcgtttaagctcgattcaagagctgtatcgcgatgagctgttcatcgttatgcgcacctactttgaaaaaccacgcactgtggtgggctggaaaggcctcattaccgacccaaatctggatggctcttacgcactagaagcaggcctgcataaagcacgtaagctattgctcgacatcaacaaacttggccttgctaccgcaactgagtttcttgacatgatcactggtcaatatattgctgatttgatcacttggggcgcgattggtgctcgaaccactgaatcgcaaattcaccgtgaaatggcatctgcactctcctgcccggttggctttaaaaacggcaccaacggcaacgtgaaaattgcgattgacgcaattcgagcatcaaaagcttcgcattacttctactctccagataaaaatggccgcatgaccgtttaccgcaccagtggtaacccatatggacacattattctgcgtggtggtgataccggccctaactttgatgcaaaatcggttgagtctgcctgtcaatcactggctgagttcgatttgccacagcgtttgatcgttgatttcagtcacgcgaactgtgaaaagcaacatcgtaaacagctcgatgtcgcgcaagacatttgtaaccagctaaaagcaggcagcacttatatcgcaggcatcatggcagaaagctttattaccgaaggcaatcagccgatgactgaccttgataacttgacctacggccaatcgatcactgacccttgcctaagctgggaacacacagcgcaaatgctggacatgcttgcgactgctgtaaaagaaagccgttaa

SEQ ID NO: 1154 - protein, 350 aa, Vibrio vulnificus CMCP6
MPLKTDELRTQPLGPMPTPAELSQAHPITDDVAERIAKSRRQIEDILTGKDNRLLVIVGPCSVHDTEAAIDYATRLSSIQELYRDELFIVMRTYFEKPRTVVGWKGLITDPNLDGSYALEAGLHKARKLLLDINKLGLATATEFLDMITGQYIADLITWGAIGARTTESQIHREMASALSCPVGFKNGTNGNVKIAIDAIRASKASHYFYSPDKNGRMTVYRTSGNPYGHIILRGGDTGPNFDAKSVESACQSLAEFDLPQRLIVDFSHANCEKQHRKQLDVAQDICNQLKAGSTYIAGIMAESFITEGNQPMTDLDNLTYGQSITDPCLSWEHTAQMLDMLATAVKESR

SEQ ID NO: 1155 - DNA, 1053 bp, Vibrio vulnificus CMCP6
  CDS (1)..(1053): transl_table=11
atgttccaaacagatgatgtaagaattaataacgttaaagagttacttccaccagtagctgttttagagaagtacccggcgactgaaaccgcttcttcgacaactttccaatcgagaaacgacattcacaacattctcatcggcaaggacgatcgcctgctggttattgtcggcccttgctctatccacgatcctgtggccgcggttgaatacggcaagcgtttgaaaacgttgcgtgacgagctcaaaggtgagctcgaaattgttatgcgcgtttactttgaaaagccacgtaccactgtgggttggaaaggtttgattaatgacccgtaccttaacgacacctacaagttgaatgatggtttacgcatgggccgaaaactgttgttggatcttaccgatatgggtcttccaacggcgagtgagttccttgacatgatcacaccacagtatgtggctgatttgatcagttggggtgcgattggtgcacgtactacggaatctcaggttcaccgtgaactggcgtcgggtctttcttgtccggttggttttaaaaatggcacggatggcaacattaagattgcaagtgatgcgattcgctcagcaagtgcttctcaccatttcctatcggtaacgaaatacggccattctgctatcgttgaaaccgcgggtaatccagactgccacattattttgcgtggtggtaaagagccaaactacagtgcagcgcatgtttcagcagtaaaagaagagctagctacatcgggtttaccacaaaaagtgatgatcgacttcagccacgccaacagctccaagcagtataagcgtcaaatgttggtggccgacgatgtctctgagcagctagcggccggtgaagaggcaatctttggggtgatgatcgaatcacatcttgtggaaggtcgacaagatcttgttgatggtaaagcggcgacttatggtcagtcgattaccgacgcttgcatcggttgggaagatactgaaactgtgcttcgccaattggcaaatgcagtggcagctcgtcgagcgaaatag

SEQ ID NO: 1156 - protein, 350 aa, Vibrio vulnificus CMCP6
MFQTDDVRINNVKELLPPVAVLEKYPATETASSTTFQSRNDIHNILIGKDDRLLVIVGPCSIHDPVAAVEYGKRLKTLRDELKGELEIVMRVYFEKPRTTVGWKGLINDPYLNDTYKLNDGLRMGRKLLLDLTDMGLPTASEFLDMITPQYVADLISWGAIGARTTESQVHRELASGLSCPVGFKNGTDGNIKIASDAIRSASASHHFLSVTKYGHSAIVETAGNPDCHIILRGGKEPNYSAAHVSAVKEELATSGLPQKVMIDFSHANSSKQYKRQMLVADDVSEQLAAGEEAIFGVMIESHLVEGRQDLVDGKAATYGQSITDACIGWEDTETVLRQLANAVAARRAK

SEQ ID NO: 1157 - DNA, 1071 bp, Vibrio vulnificus CMCP6
  CDS (1)..(1071): transl_table=11
atgcctacgctcagcaaattgattcactccactccttgtggaacactcccttctgtggaagagatcattcaacacgcctcactggacgaagagagcgaagcgtttatccgacaacgtcgccaagacatcactcgaattctgaatggccaagaccctcgattactggtgatcatcggcccatgttcaattcacgacccgcaagcaggcctagaatatgcgcagaaactggccaacattcagcatcagcatgaaaagcaacttctgattgtgatgcgaacttactttgaaaaaccgcgcacacgcgcaggatggaaagggctgatcgtcgatcccgatctcgataacagccacgacattaataaaggtctgcggcttgctcgacaattcttacagcaagtcatcaagcttggccttgcgacggcaaccgagtatttagacaccacgacttacccctatatttctgacctcatttgctggggtgccattggcgcgaggacaactgaatctcaaattcaccgtcaaatggcctcggcgcttccctgtcctattggtttcaaaaacgggaccgacggcaatgttgatattgctatcgacgcgatacacgcggcaaactcaccccatctcatctgtgtgccaggatttggggcacgtactctcacagccatcagtcatggtaaccccaatggccatatcattttgcgaggtggcaaaacgccaaactacaccaccgagcatgtttgccaaatcagccaacaactggaagccaacgatcttaacccgcgcctgatcattgattgcagccatggcaatagcctgaaagtggcaaagaaccaactcgatgtggcgagaaacatcgcctgtcagttgatcgaaggagaaaaatgcattgcaggcgtgatggcggagagcttcttggtagcaggcgcgcaaaagatcaccgatcgtccgttggtcaaaggcatgtcgattactgatgaatgtttggggtgggaagagacggaaagtattctcaatatttttgcggaagcggtgaatgtcgtgatgacggagcgcttttccaccgttgcctaa

SEQ ID NO: 1158 - protein, 356 aa, Vibrio vulnificus CMCP6
MPTLSKLIHSTPCGTLPSVEEIIQHASLDEESEAFIRQRRQDITRILNGQDPRLLVIIGPCSIHDPQAGLEYAQKLANIQHQHEKQLLIVMRTYFEKPRTRAGWKGLIVDPDLDNSHDINKGLRLARQFLQQVIKLGLATATEYLDTTTYPYISDLICWGAIGARTTESQIHRQMASALPCPIGFKNGTDGNVDIAIDAIHAANSPHLICVPGFGARTLTAISHGNPNGHIILRGGKTPNYTTEHVCQISQQLEANDLNPRLIIDCSHGNSLKVAKNQLDVARNIACQLIEGEKCIAGVMAESFLVAGAQKITDRPLVKGMSITDECLGWEETESILNIFAEAVNVVMTERFSTVA

SEQ ID NO: 1159 - DNA, 1086 bp, Bradyrhizobium japonicum USDA 110
  CDS (1)..(1086): transl_table=11
gtgctgagcacgactgacgatcttcgtatccgtgaactgaaagagctgagcacgccggatgaggtaatgcgggaggtcccgcgcacgctcaccgcaacgcgtgtggtgatggcggcgcgcaacgccatccatgccatcctcaccggccaggacgaccgcctgctggtggtggtcggcccgtgctcggtgcatgatccccgggccgcgctcgactacgctgagcgtctgacaaaactgcgcgaggacctcgccgaccagctcgagatcgtaatgcgggtctatttcgagaagccgcgcaccaccgtcggctggaagggcctgatcaacgaccccgatctcgacggcagcttcgacatcaacaagggcctgcggctggcgcgcaacgtgctgtcagcggtgaacaatctcggcctcccggccggcgccgaattcctggacatgacgacgccgcaatacatcgctgacctcgtgtcctgggccgcgatcggcgcgcgcacgaccgagagccagatccatcgcgagctggcctccgggctgtcctgcccggtcggcttcaagaacggcaccgatggcaatgtgcggatcgcggcggacgcagtgaagtcggcctcgcatccgcatcatttcatggcggtgaccaagctcggccgctcggcgatcgcctcgaccgcgggcaacgaggactgccacatcatcctgcgcggcggcagcacgccgaactacgatgcggcaagcgtcgcggcggcctgcaacgagctggcgaaatccggcgtcgcgccgctggtgatggtggatgcgagccacgccaattcgagcaagaagccggagaaccagccgctggtcatggccgacattgccggccagatttccggtggcgagagccgcatcatgggtgtgatgatcgagagcaatctcgtcgccggccgccaggacgtggttccgggcaagccgctcacctacggccagagcatcacggacggctgtatcgactgggcgaccacggcaactgtgctcgagcagctcgccgatgcggtcgaaatccggcgcaacgcccagcgcgcggggctgcacgagcgctcggcgtaa

SEQ ID NO: 1160 - protein, 361 aa, Bradyrhizobium japonicum USDA 110
MLSTTDDLRIRELKELSTPDEVMREVPRTLTATRVVMAARNAIHAILTGQDDRLLVVVGPCSVHDPRAALDYAERLTKLREDLADQLEIVMRVYFEKPRTTVGWKGLINDPDLDGSFDINKGLRLARNVLSAVNNLGLPAGAEFLDMTTPQYIADLVSWAAIGARTTESQIHRELASGLSCPVGFKNGTDGNVRIAADAVKSASHPHHFMAVTKLGRSAIASTAGNEDCHIILRGGSTPNYDAASVAAACNELAKSGVAPLVMVDASHANSSKKPENQPLVMADIAGQISGGESRIMGVMIESNLVAGRQDVVPGKPLTYGQSITDGCIDWATTATVLEQLADAVEIRRNAQRAGLHERSA

SEQ ID NO: 1161 - DNA, 1095 bp, Xylella fastidiosa Temecula1
  CDS (1)..(1095): transl_table=11
atgccaccatttaccgacgacctccgtatccgaaaaattgaaccactgacacctcctaacaagctcctcttacaactaccatgcgatgagcaggcatcgctgactgttgcgacctcacgcaacgcactgcacgatatcctgcacggccacaatgaccgtttagccgtcgtgataggcccatgctcaatccatgatccaattgcagccattgattactcgcaacgtctacgcccattgcgtgagatgtacaaggatgcactagaaatcgtgatgcgagtttactttcagaaaccgcgcaccactattggttggaaaggattggtcaacgatccggatcttgatggcagcttccagatcaataagggcttgcatatcgcgcgcaacctgctgcgcgatatcaatcatctcggcttacccgctggtgtggaatttctagacacgatttcgccgcaatatctggctgacttagtcgcctggggtgccattggtgctcgcaccactgaaagccaaatacaccgtgaaatggcttcaggtttatcgtgcccgattggctttaaaaacagtaccagtggtgatgtgaagattgctgctgacgcgattaaagcagcttcgcatccgcaccatttcctttcagtgacaaagacaggtgttgccgcagtcgtcgccacccagggtaaccccgattgtcacgtgattctgcgtggaggcaaggtcccgaattacgacgcaatcaatgtcgaagctgccagccaaacattgcttaaatccaagctaccggtgcgactgatgattgatgcgagccatgccaatagcggcaaaaatccaaacaatcaacctaaggtgatcgagaacatcgtagaacagcttaaagccggtgaacgccgcatcatcggtgtcatgattgaaagccacattgttggtggccggcaagaattagtccttggaaacacacttaactatggacagagcattaccgatgcttgcatcgactgggatacctcggttgcaatgttagaacagctcgctcaggccgtacgcgtcagacagactctaccaacgaccactacagctaacaaaacatcaaaaacccaataa

SEQ ID NO: 1162 - protein, 364 aa, Xylella fastidiosa Temecula1
MPPFTDDLRIRKIEPLTPPNKLLLQLPCDEQASLTVATSRNALHDILHGHNDRLAVVIGPCSIHDPIAAIDYSQRLRPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGKVPNYDAINVEAASQTLLKSKLPVRLMIDASHANSGKNPNNQPKVIENIVEQLKAGERRIIGVMIESHIVGGRQELVLGNTLNYGQSITDACIDWDTSVAMLEQLAQAVRVRQTLPTTTTANKTSKTQ

SEQ ID NO: 1163 - DNA, 1143 bp, Xylella fastidiosa Temecula1
  CDS (1)..(1143): transl_table=11
ttgtctcctccgcttggtctatgtctaaatgttctgagattacatcccatgccaccatttaccgacgacctccgtatccgaaaaattgaaccactgacacctcctaacaagctcctcttacaactaccatgcgatgagcaggcatcgctgactgttgcgacctcacgcaacgcactgcacgatatcctgcacggccacaatgaccgtttagccgtcgtgataggcccatgctcaatccatgatccaattgcagccattgattactcgcaacgtctacgcccattgcgtgagatgtacaaggatgcactagaaatcgtgatgcgagtttactttcagaaaccgcgcaccactattggttggaaaggattggtcaacgatccggatcttgatggcagcttccagatcaataagggcttgcatatcgcgcgcaacctgctgcgcgatatcaatcatctcggcttacccgctggtgtggaatttctagacacgatttcgccgcaatatctggctgacttagtcgcctggggtgccattggtgctcgcaccactgaaagccaaatacaccgtgaaatggcttcaggtttatcgtgcccgattggctttaaaaacagtaccagtggtgatgtgaagattgctgctgacgcgattaaagcagcttcgcatccgcaccatttcctttcagtgacaaagacaggtgttgccgcagtcgtcgccacccagggtaaccccgattgtcacgtgattctgcgtggaggcaaggtcccgaattacgacgcaatcaatgtcgaagctgccagccaaacattgcttaaatccaagctaccggtgcgactgatgattgatgcgagccatgccaatagcggcaaaaatccaaacaatcaacctaaggtgatcgagaacatcgtagaacagcttaaagccggtgaacgccgcatcatcggtgtcatgattgaaagccacattgttggtggccggcaagaattagtccttggaaacacacttaactatggacagagcattaccgatgcttgcatcgactgggatacctcggttgcaatgttagaacagctcgctcaggccgtacgcgtcagacagactctaccaacgaccactacagctaacaaaacatcaaaaacccaataa

SEQ ID NO: 1164 - protein, 380 aa, Xylella fastidiosa Temecula1
MSPPLGLCLNVLRLHPMPPFTDDLRIRKIEPLTPPNKLLLQLPCDEQASLTVATSRNALHDILHGHNDRLAVVIGPCSIHDPIAAIDYSQRLRPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGKVPNYDAINVEAASQTLLKSKLPVRLMIDASHANSGKNPNNQPKVIENIVEQLKAGERRIIGVMIESHIVGGRQELVLGNTLNYGQSITDACIDWDTSVAMLEQLAQAVRVRQTLPTTTTANKTSKTQ

SEQ ID NO: 1165 - DNA, 1077 bp, Pseudomonas syringae pv. tomato str. DC3000
  CDS (1)..(1077): transl_table=11
atggctgatttaccgattaacgacctcaacgttgcctccaacgagactctgatcacaccggatcagctcaagcgcgacatcccgctgaccgacgctgcactgcagactgtcagccagggtcgcgaagtgattcgcaacattctcgatggcaatgatcaccgcctgttcatcgtgatcggcccgtgctcgatccacgacctgaaagcggccaaagagtacgccgagcgcctcaaggtactggcggcggaagtttccgacacgctgtatctggtcatgcgcgtgtacttcgagaagcctcgcaccacagtgggctggaaaggcctgatcaacgacccgtacctggatgactcgttcaagatccaggatggcttgcacatcggccgccaactgctgctggacctggctgaaatgggcctgccgaccgcaaccgaagcgctggacccgatctccccgcaatacctgcaggacctgatcagctggtcggccatcggcgcgcgcaccaccgaatcgcagacccaccgcgagatggcttccggcctgtcttcggccgtcggcttcaagaacggcaccgacggcggcctgaccgttgccatcaacgctctgcagtcggtctcaagcccgcatcgcttcctgggcatcaaccaggaaggcggcgtgtcgatcgtgaccaccaagggcaacgcctatggccacgtcgtgctacgcggtggcaatggcaagcccaactatgattcggtcagcgtcgcgctctgcgagcaggcgctgaacaaggccggcattcgccccaacatcatggtcgattgcagccacgccaactccaacaaggacccggccctgcaaccgctggtgatggaaaacgtcgccaaccagattctggaaggcaacgagtcgatcatcggcctgatggtcgagagccatctgaactggggttgtcaggcgattcccaaggatctgtcggaattgcagtacggcgtctccatcaccgatgcctgcatcgactgggaaagcactgaaaaaaccctgcgcagcatgcatgccaagctcaagggcgtactgccggcgcgcacgcgtaaatga

SEQ ID NO: 1166 - protein, 358 aa, Pseudomonas syringae pv. tomato str. DC3000
MADLPINDLNVASNETLITPDQLKRDIPLTDAALQTVSQGREVIRNILDGNDHRLFIVIGPCSIHDLKAAKEYAERLKVLAAEVSDTLYLVMRVYFEKPRTTVGWKGLINDPYLDDSFKIQDGLHIGRQLLLDLAEMGLPTATEALDPISPQYLQDLISWSAIGARTTESQTHREMASGLSSAVGFKNGTDGGLTVAINALQSVSSPHRFLGINQEGGVSIVTTKGNAYGHVVLRGGNGKPNYDSVSVALCEQALNKAGIRPNIMVDCSHANSNKDPALQPLVMENVANQILEGNESIIGLMVESHLNWGCQAIPKDLSELQYGVSITDACIDWESTEKTLRSMHAKLKGVLPARTRK

SEQ ID NO: 1167 - DNA, 1083 bp, Pseudomonas syringae pv. tomato str. DC3000
  CDS (1)..(1083): transl_table=11
atgaattcgcccgttgccgtaaaatcgtccgacctgtccagccatgccgtcacattggcggacaacaaccccgcctcgaaacgcctgcccagcacgcttgagcttaaaatgcgcctgccactcaatgccacgctgaccgaacaggttgcagcccatcgccgcgccgtgcgcgccattctcaatggcgaagactcacgactgctggtcatcgtgggcccctgctcgatccatgatccgcaatccgcgctggaatatgccgagcgactcgccagcctggccgcagaagtcagcgatcagatgctgctggtgatgcgtgcctacgtcgaaaaaccgcgcaccaccgtaggctggaaaggcctggcgtacgaccccgacctggatggcagtgacgacatggccggcggcttgacgctgtcgcggcagttgatgcgtgacatgctgggcatgggcctgccgatcgccaccgaaatactgcagcccatggctgccggctacttcgacgacctgctcagctgggtcgccattggcgctcgcaccaccgaatcgcagatccaccgggaaatggccagcgggctgcccatggcggttggcttcaagaacggcacggatggcggcgtagcggtggccagcgacgcaatgcgctcagcggcgcacccgcatcgtcatttcggcatggacgctcacggtcacccggcgatcatcgagacgcagggcaatccggacacgcacatcgtgcttcgcggcggacacagcggccccaactacgatcgccagagcgttgctcaggtgcaggccggcctgagcaataacgccatagcgtcgcgaatcatggtcgattgcagccacgccaacagcggcaaggacccggcgcgtcagcctcacgtgttcaacgatgtgcttgaacagcgcttgtccggcaacccgtcactgattggcatgatgatcgagagccatctacacgatggctgccaggcgctgggcgaaacgctgcagtacggggtgtcggttaccgacggctgcctgggctggaccgcgaccgagcagttgttgcgtgaagcggtcgaccgcttgcgttacagataa

SEQ ID NO: 1168 - protein, 360 aa, Pseudomonas syringae pv. tomato str. DC3000
MNSPVAVKSSDLSSHAVTLADNNPASKRLPSTLELKMRLPLNATLTEQVAAHRRAVRAILNGEDSRLLVIVGPCSIHDPQSALEYAERLASLAAEVSDQMLLVMRAYVEKPRTTVGWKGLAYDPDLDGSDDMAGGLTLSRQLMRDMLGMGLPIATEILQPMAAGYFDDLLSWVAIGARTTESQIHREMASGLPMAVGFKNGTDGGVAVASDAMRSAAHPHRHFGMDAHGHPAIIETQGNPDTHIVLRGGHSGPNYDRQSVAQVQAGLSNNAIASRIMVDCSHANSGKDPARQPHVFNDVLEQRLSGNPSLIGMMIESHLHDGCQALGETLQYGVSVTDGCLGWTATEQLLREAVDRLRYR

SEQ ID NO: 1169 - DNA, 1074 bp, Vibrio parahaemolyticus RIMD 2210633
  CDS (1)..(1074): transl_table=11
atgcaaaaaagtgaattgagcaatattaacatcagcgatgaacaggttcttattacgccagatgagctaaaagtgaagcttcctcttagtgaaaaggcacgccgttttattcaagaatctcgccaaaccatcgccaacatcattcacaaaaaagaccatcgcctacttgtcgtatgtggaccatgctctatccatgacattgaagccgcaaaggattacgcgaagcgtctaaaagctctttctgaacaactaagcgaccaactgtatattgtaatgcgtgtttactttgagaagccgcgcaccacggtcggctggaaaggcctgatcaatgacccacacctagatggcagcttcgacattgaacacggtctgcatgtaggacgtgaactgctggtggaactggcggaaatggaaatcccacttgcaaccgaagctcttgacccaattagcccacaatacttagccgatacttttagttgggcagcgatcggcgcacgcacaacagaatcacaaacacaccgtgagatggctagtggtctttcgatgccgattggctttaagaatggcacagatggtagtttggcaaccgcaatcaatgcgatgcaggcagcctcttctagccaccgctttatgggtatcaaccgtgaaggtcaagttgcgttgctcacaacccaaggtaacccgaatggccacgtgatcctacgtggtggtaaacagacgaactacgattcagtatccgttacggaatgcgaacaagaaatggcgaaatcaggtcttgaagcgtcattgatggtggattgcagccatgcaaactcacgcaaagattaccgtcgtcagccattggtcgcagaagatgtgattcaccaaatccgtgaagggaacaagtcgatcatcggtttgatgatcgagagccacatcaatgaaggtaatcaatcttctgagctggcgttggatgagatgaaatacggcgtatctatcactgacgcttgtattaattgggagtcaactgaggcactattacgtcatgcacacgaagagctggtgcctttcttagaaaaccgccttaaaggctaa

SEQ ID NO: 1170 - protein, 357 aa, Vibrio parahaemolyticus RIMD 2210633
MQKSELSNINISDEQVLITPDELKVKLPLSEKARRFIQESRQTIANIIHKKDHRLLVVCGPCSIHDIEAAKDYAKRLKALSEQLSDQLYIVMRVYFEKPRTTVGWKGLINDPHLDGSFDIEHGLHVGRELLVELAEMEIPLATEALDPISPQYLADTFSWAAIGARTTESQTHREMASGLSMPIGFKNGTDGSLATAINAMQAASSSHRFMGINREGQVALLTTQGNPNGHVILRGGKQTNYDSVSVTECEQEMAKSGLEASLMVDCSHANSRKDYRRQPLVAEDVIHQIREGNKSIIGLMIESHINEGNQSSELALDEMKYGVSITDACINWESTEALLRHAHEELVPFLENRLKG

SEQ ID NO: 1171 - DNA, 1053 bp, Vibrio parahaemolyticus RIMD 2210633
  CDS (1)..(1053): transl_table=11
atgcctataaaaacagatgaattgagaacccaacctttgggtccaatgcctaccccagcggagctaggtagtgtacatccgatcacggatgacgttgcagatcgcatcgctcaatctcgtcgtcagattgaaaacattttaacaggtgaagacgatcgccttcttgctatcgttggtccatgttctgttcacgatactgaagccgcaattgattacgcgaaacgcttgagtgaaatccaagataagtacaaagacgagctatttatcgttatgcgtacttactttgaaaagcctcgtacagtagttggttggaaaggtcttatcaccgaccctaacctagacggttcttacgcgcttgaagctggccttcacaaagctcgtaaactgctactggatatcaacaagcttggtcttgcgactgctactgagtttcttgatatgatcactggccaatacattgcggatttgatcacttggggcgcaattggcgcacgtacgacagaatctcaaattcaccgtgaaatggcatcagcgctatcttgccctgttggctttaaaaatggcacaaacggtaatgtgaaaatcgcgattgacgcgattcgtgcctcccaagcttcacactacttctactcgccagataagaatggtcgtatgacggtgtaccgcacaagtggcaacccattcggtcatattattttgcgtggcggcgaaaaaggtccaaactttgacgaagcatctgtgaagcaagcgtgtgattcacttgctgagtttggtttacctgagcgtcttattgtagacttcagtcatgcaaactgtcagaagcagcaccgaaaacaacttgatgttgcgagcgacatttgtactcaaattaagtcaggcagcactcgcattgcgggtatcatggcggaaagcttcattatggaaggcaaccagccaatgactgacattaacaacctaacttacggtcaatcaattactgacccttgtttaggttgggacgatacagtaactatgctagatatgctggcagaagctgtaaaatccactaagtaa

SEQ ID NO: 1172 - protein, 350 aa, Vibrio parahaemolyticus RIMD 2210633
MPIKTDELRTQPLGPMPTPAELGSVHPITDDVADRIAQSRRQIENILTGEDDRLLAIVGPCSVHDTEAAIDYAKRLSEIQDKYKDELFIVMRTYFEKPRTVVGWKGLITDPNLDGSYALEAGLHKARKLLLDINKLGLATATEFLDMITGQYIADLITWGAIGARTTESQIHREMASALSCPVGFKNGTNGNVKIAIDAIRASQASHYFYSPDKNGRMTVYRTSGNPFGHIILRGGEKGPNFDEASVKQACDSLAEFGLPERLIVDFSHANCQKQHRKQLDVASDICTQIKSGSTRIAGIMAESFIMEGNQPMTDINNLTYGQSITDPCLGWDDTVTMLDMLAEAVKSTK

SEQ ID NO: 1173 - DNA, 1053 bp, Vibrio parahaemolyticus RIMD 2210633
  CDS (1)..(1053): transl_table=11
atgtttcaaactgatgatgtaagaattaatagagtaaaagagttattgccccctgttgcagttctagagaagttcccagcgaccgaaaccgcttcttcgaccacttttgattgccgtaatgccattcacaatattcttgaaggaaaagatgatcgtttacttgtgatcgttggtccttgctctatccatgatcctgcagctgcagttgaatacggcaaaaagctgaaagtgttgcgtgatgaacttggtgagcaactggaagttgtgatgcgagtttactttgaaaaaccacgtacgacagtcggctggaaaggtttgatcaacgacccatacctgaacgacacatttaagctaaatgacggtcttcgtattggacgtaagctgcttttggatctcactgacatgggcctaccaacagcgagtgaattcctagacatgattacgcctcaatacgttgcggatttgatcagctggggcgcgattggtgcacgcacgacggaatcgcaagttcaccgcgaactcgcttctggtctttcttgcccggttggtttcaaaaacggtactgacggtaacattaaaatcgcgagtgatgctattcgctctgcaagcgcttctcaccatttcctatcggtaacgaagtacggtcattcagcgattgttgaaaccgcaggtaacccagactgccacatcattttacgtggtggtaaagaaccaaactacagtgcagcacacgttgctcaaatcaaagacgagttggacgcggctggtctaccgaagaaagtgatgatcgattttagccacgcgaacagctctaagcagttcaaacgtcaaatgcttgtgtctgatgatgtatcagagcaaatcgctggtggtgaagatgcaatctttggcgtgatgatcgagtctcatttggttgaaggccgccaagatttagtggatggtaaagtggcaacttacggtcagtcgattactgatgcatgtattggttgggacgatacggaaacggtacttcgtcagctttctgaagcagtaaaagcgcgccgtagcaaataa

SEQ ID NO: 1174 - protein, 350 aa, Vibrio parahaemolyticus RIMD 2210633
MFQTDDVRINRVKELLPPVAVLEKFPATETASSTTFDCRNAIHNILEGKDDRLLVIVGPCSIHDPAAAVEYGKKLKVLRDELGEQLEVVMRVYFEKPRTTVGWKGLINDPYLNDTFKLNDGLRIGRKLLLDLTDMGLPTASEFLDMITPQYVADLISWGAIGARTTESQVHRELASGLSCPVGFKNGTDGNIKIASDAIRSASASHHFLSVTKYGHSAIVETAGNPDCHIILRGGKEPNYSAAHVAQIKDELDAAGLPKKVMIDFSHANSSKQFKRQMLVSDDVSEQIAGGEDAIFGVMIESHLVEGRQDLVDGKVATYGQSITDACIGWDDTETVLRQLSEAVKARRSK

SEQ ID NO: 1175 - DNA, 1053 bp, Salmonella enterica subsp. enterica serovar Typhi Ty2
  CDS (1)..(1053): transl_table=11
atgaattatcagaatgacgatttacgcattaaagaaatcaacgagttattacctccggtcgcgctgctggaaaagtttcccgccacggaaaatgcagcaaataccgttgctcacgcacgcaaagccatccataaaattctcaaaggcaatgacgatcgtctgctggtggtgatcggtccttgttcaattcatgatccggcagcggcgaaagagtatgccgcccgtttgctggcgctacgcgatgagcttcaaggcgagcttgaaattgtcatgcgcgtctattttgagaaaccgcgtactaccgtcggctggaaagggctgattaacgatccgcacatggataacagcttccagattaacgacggtctgcgtattgcgcgcaaactgctgctggatattaacgacagcggcctgcctgccgccggcgaattcctcgatatgatcacgccgcaatatctggccgatctgatgagctggggcgccattggcgcacggactactgaatcccaggttcatcgcgaactggcgtctggcctctcttgtccggtcggttttaaaaatggtactgatggcacgattaaagtcgccattgacgccatcaacgccgccggcgcgccgcattgcttcctctccgtcactaaatggggtcattcggcgattgtgaataccagcggcaacggcgactgccatatcattctgcgcggcggtaaagcgccaaactatagcgcgcaacatgttgctgaggtgaaagaaggcctcatcaaagcgggactgacgccgcaggtcatgatcgatttcagccatgccaactcctgtaagcaatttcaaaagcagatggaggtttgcgccgatgtctgtcagcagatagcgggcggtgaaaaagcgattattggcgtgatggtagagagtcatctggtagaaggaaaccagagtctggaaagcggtcagccgctgacctacggtaaaagcattactgacgcctgtattggctgggaagataccgatgcgctgcttcgtcagttgtcggcagcggtaaaagcccgtcgaggttaa

SEQ ID NO: 1176 - protein, 350 aa, Salmonella enterica subsp. enterica serovar Typhi Ty2
MNYQNDDLRIKEINELLPPVALLEKFPATENAANTVAHARKAIHKILKGNDDRLLVVIGPCSIHDPAAAKEYAARLLALRDELQGELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKAPNYSAQHVAEVKEGLIKAGLTPQVMIDFSHANSCKQFQKQMEVCADVCQQIAGGEKAIIGVMVESHLVEGNQSLESGQPLTYGKSITDACIGWEDTDALLRQLSAAVKARRG

SEQ ID NO: 1177 - DNA, 1083 bp, Coxiella burnetii RSA 493
  CDS (1)..(1083): transl_table=11
atgcagaaaactgacaatttaagaataaaagccatccaccccctgatgctccccgcccttctcatcgaagagctgcccatcacagccgctgtagcttcaaccgtcaacctagctcgattagctgccagagacatcattcacggccaagatgaccgtttgttagtagtccttggcccttgctccattcacgacgttaaagccgccctcgaatacgctaatcgactcaaacgctgtattgatcgacacgctaaggaactgtgcatcatcatgcgcgtttattttgaaaaaccccgaacgaccgttggatggaagggcttgattaacgacccccagctcgatggaagtttccacattaaccaagggctgcgggtcgcccggcgtttactgctcgacattaatgaaatcggggttcctaccggaagcgaatttctagacaccattataccccagtatatttctgatttaacttcgtggtccgccatcggcgctcgcacgaccgaaagccaaacccaccgagagctagcttctggcctttcaatgccaattggcttcaaaaacggtaccacgggcaatgtccaaatcgccattgatgcagtgctggctgcccgacaagcccatcattttttaggggtatccaaacaaggcatcgctgctattatcattacaaaaggaaaccctgacggtcacgtgattttgcgcggctcctcccagagcaccaactatgatcccaaatccattgaagaagccattctgaaactcaaagctaaccatttacccccctcggtgatggttgactgtagccacggcaatagccgcaaaaaccacaaaaatcaaatgcgagttgttgacgccttatacgatcaaattacccaaggcagctcttatttattgggcgccatgattgaaagtaatttagttgaagggaaacaaaccctcgaatccggaaaagctttaacctatgggcagagcatcaccgatgcttgcatctcgtgggaagataccgaacttgcgttggaaaaactggcacaagccgttattattcggcgccaacacagcgaagagagaaaacatcatggcgaataa

SEQ ID NO: 1178 - protein, 360 aa, Coxiella burnetii RSA 493
MQKTDNLRIKAIHPLMLPALLIEELPITAAVASTVNLARLAARDIIHGQDDRLLVVLGPCSIHDVKAALEYANRLKRCIDRHAKELCIIMRVYFEKPRTTVGWKGLINDPQLDGSFHINQGLRVARRLLLDINEIGVPTGSEFLDTIIPQYISDLTSWSAIGARTTESQTHRELASGLSMPIGFKNGTTGNVQIAIDAVLAARQAHHFLGVSKQGIAAIIITKGNPDGHVILRGSSQSTNYDPKSIEEAILKLKANHLPPSVMVDCSHGNSRKNHKNQMRVVDALYDQITQGSSYLLGAMIESNLVEGKQTLESGKALTYGQSITDACISWEDTELALEKLAQAVIIRRQHSEERKHHGE

SEQ ID NO: 1179 - DNA, 1179 bp, Nitrosomonas europaea ATCC 19718
  CDS (1)..(1179): transl_table=11
atgaagtcgggcagtctgtattgccagtgtggcaaggaagtgcaaaaagaaatagtcatcaaggaatcatctgtggaacataaaactgacgaccggcgcattatcagaggagatgagctgatcacgccggtgaaactgcttcatgatcatcctctgactgaacaggcgactgaaactgtggttactgccagacaggagtgccacgatattttgcggggagaggatgaccggttactggtggtatgtggcccatgctcgattcatgatgtggatgcggcagtggaatatgcttcccgactgagtcatctgcgtcaggagctgaaagatcagttacatatcatcatgcgggtttatttcgagaaacctcgcacaacagttggctggaaaggcctgatcaacgacccagacctggataacagtttcaacattgacaagggattgcggcttgcccgcgacctgttgctgaaactgggtaatataaatatgccggctgcaactgaatttcttgatctgatcagcccgcaatatgtggctgacctcatcagttgggcggccatcggcgcacgcacgactgaaagccagggacatcgtgaactggcctccggtgtttcgtgtccagtggggttcaagaatggtacctacggcaatctgaatatcgcaatcgatgcgattggtgctgcatcccacccgcataatttcctgtcagtcaccaaagaaggccgggttgctactttcaccaccaggggaaatgaagattgtcatatcatcctgcgcggcggaagatcaccgaattacgatgcagagagtgttgcttctgcggtcgaagcactgcggaaagccaagctgcctccttatctgatgatcgattgcagtcacgccaacagccacaaggattaccggcgtcagccggaagtggctgccgatgtggctcagcaaattgcggaaggaaactgctcaatcagcgggatcatgcttgaaagtcacctggtggccggcaggcagaatgttgaaggtaagcggcgggaagagctggtttacgggcaaagcatcacggatggctgtatcgatttcgatacgacacagcaggtgctgttcgagctggcggaagcggtggaaaaacgaagaaatttgcagaataccccgatactggttccagatcattccactgcgctttcctga

SEQ ID NO: 1180 - protein, 392 aa, Nitrosomonas europaea ATCC 19718
MKSGSLYCQCGKEVQKEIVIKESSVEHKTDDRRIIRGDELITPVKLLHDHPLTEQATETVVTARQECHDILRGEDDRLLVVCGPCSIHDVDAAVEYASRLSHLRQELKDQLHIIMRVYFEKPRTTVGWKGLINDPDLDNSFNIDKGLRLARDLLLKLGNINMPAATEFLDLISPQYVADLISWAAIGARTTESQGHRELASGVSCPVGFKNGTYGNLNIAIDAIGAASHPHNFLSVTKEGRVATFTTRGNEDCHIILRGGRSPNYDAESVASAVEALRKAKLPPYLMIDCSHANSHKDYRRQPEVAADVAQQIAEGNCSISGIMLESHLVAGRQNVEGKRREELVYGQSITDGCIDFDTTQQVLFELAEAVEKRRNLQNTPILVPDHSTALS

SEQ ID NO: 1181 - DNA, 1053 bp, Rhodopirellula baltica SH 1
  CDS (1)..(1053): transl_table=11
atgatccgcaccgatgaccttcgtatcggcgccatcaaaaatctgatgtcccccagtgaattgctatccgaaattccggccagcgatgcgatttcacagacggtcgctgacggtcgaaccgcgatccaaaacgtgcttcagcagaaggacgaccgtttgctcgtcgtcgtcgggccgtgttcgattcacgatccggattccgctcgtcagtacgcggagaagttggcggtcgagcaaaaaaagcacgccgatgagctgttgatcgtcatgcgggtttacttcgaaaaacctcgaacaacggttggctggaagggtctgatcaacgaccccaaacttgacgacagcttcgaaatcaatcacggattgcgaaccgctcggcgtttgctcagcgacatcaacgcgatgggactgccgaccggaaccgagtttttggatttgatcagcccgcagtatgtggctgacttggtcgggtggggtgccatcggagcacgcacgaccgaaagccaaggtcaccgcgaattggcgtcggggctgtcttgcccggtcggcttcaaaaatggaaccagcggcaacgttcagatcgctgtcgatgcgatttgctccgcacgtcgaccacaccacttcctatccgtcacgaaggaaggaacctcggcgatcttcgcaacaaccggaaacccggactgccacatcattctgcgtggcggaaagcacaccaactacgatgccgccagcatcgatatggcatcgggattgctcgagaaagcggacctgccagcacgaatcatgatcgattgcagccacgcgaacagccgcaagattttcaaacgtcaatcgtacgtttgccgggacatctgtgcccaagtatccgatggcgaccaacgcatcatgggcgtgatgatcgaaagcaatctgctcgagggcaaccaaaaactcagcgattcgccgcttgttcagggtctcagcgtcaccgatgcgtgtatcggttgggaaaccaccgagcaactcttcagcgacctgggaaaatccgtcgccgcacgccgtaaagtcggctga

SEQ ID NO: 1182 - protein, 350 aa, Rhodopirellula baltica SH 1
MIRTDDLRIGAIKNLMSPSELLSEIPASDAISQTVADGRTAIQNVLQQKDDRLLVVVGPCSIHDPDSARQYAEKLAVEQKKHADELLIVMRVYFEKPRTTVGWKGLINDPKLDDSFEINHGLRTARRLLSDINAMGLPTGTEFLDLISPQYVADLVGWGAIGARTTESQGHRELASGLSCPVGFKNGTSGNVQIAVDAICSARRPHHFLSVTKEGTSAIFATTGNPDCHIILRGGKHTNYDAASIDMASGLLEKADLPARIMIDCSHANSRKIFKRQSYVCRDICAQVSDGDQRIMGVMIESNLLEGNQKLSDSPLVQGLSVTDACIGWETTEQLFSDLGKSVAARRKVG

SEQ ID NO: 1183 - DNA, 1038 bp, Wigglesworthia glossinidia endosymbiont of Glossina brevipalpis
  CDS (1)..(1038): transl_table=11
atgaattatatttgtgaaaaaattaaatataaaaaattaataagcccaaaaaaattaaaaaaaatttttaaaataaaaaaagaagaagaattttttgttttaagatctagaaaaactattagtaatattattaataaaaaagacaatagaaaattaattatatgtggtccttgctctattcatgatatagaatccacaattgaatatgcaagaaaattaaatattttgtacaaaaaattaatagataaaatatatattgtaataatgatacgttatgaaaaaaaaataaatttttcagaatggaagggaatgatttatgatccatatttgaatggattacatgatattaatcatggattaaaagttattagaaatttgttaattaagttaataaaaatcaaacaacctatagcaatagatatattgaatccatttttttattattatttcgatgatgttattagttgggcatctattggatctgatctaataaattctcaaattagtttagcattttcgtctaattcatcaatcccaataggttttaaaaatagttcagatggaaatatagaaaatactttaaatgcaattataaagtattctaaaattaatgaatttattggaataaatgaaagtggaaaatcttgtattataagaagcccaggaaatattaataatcatattatattaataggtggaaattttccaaattattttcttcaaaatatatatgattgcaaaaaaagaatgaagaattctagaattactacatctataatgatagattgcaacaatggaaattattataaaaattataatgatcaaatagaagtaattaaatcatgtattaagtttttaaaaaaaaataataaaataattataggactaataataaaaagctatattaattctggaaatcagaagtttatttttcctaaaaataaaataaaatatggattatcaataaccagtccttgtattaatttaaaagatactaaactttttttacataatttatatgaatcaataaatatataa

SEQ ID NO: 1184 - protein, 345 aa, Wigglesworthia glossinidia endosymbiont of Glossina brevipalpis
MNYICEKIKYKKLISPKKLKKIFKIKKEEEFFVLRSRKTISNIINKKDNRKLIICGPCSIHDIESTIEYARKLNILYKKLIDKIYIVIMIRYEKKINFSEWKGMIYDPYLNGLHDINHGLKVIRNLLIKLIKIKQPIAIDILNPFFYYYFDDVISWASIGSDLINSQISLAFSSNSSIPIGFKNSSDGNIENTLNAIIKYSKINEFIGINESGKSCIIRSPGNINNHIILIGGNFPNYFLQNIYDCKKRMKNSRITTSIMIDCNNGNYYKNYNDQIEVIKSCIKFLKKNNKIIIGLIIKSYINSGNQKFIFPKNKIKYGLSITSPCINLKDTKLFLHNLYESINI

SEQ ID NO: 1185 - DNA, 1080 bp, Haemophilus ducreyi 35000HP
  CDS (1)..(1080): transl_table=11
gtggattctgtagcaaatcaagatagtttacataatgtaaatatctctactgaaaaagtattacttactccaaaacaactaaaaactgagtttccattacccgatcatttacgtaagcaaattgaaaaatcacgccaagaaattgccgcgattattcataaaaaagatccacgtaaacttattatcatcggaccttgttctattcacgatatctctgccgcattagagtatggccaaaaactaaaaaaattagccgaccaagtaagcgatcaactttatattgtaatgcgggtatattttgaaaaaccgcgcaccaccgtaggatggaagggcttaattaacgatccacaaatagatggcacttttaatgttgaagccggtttacgcattgcacgtaaattgtgcttagatttaactgaactaggcttaccattagccacagaagcactagatccaatgacaccacaatatttagcagatctttttagctggtcagcgattggagcaagaacgactgaatcacaaacacatcgtgaattagcttctggtttatctatggccgttggctttaaaaatggcactgatggcggcctagctgtggcgattaacgccatgcaatctgccgcacaaccgcatcgtttcattggtatcaatcaaaatggacaggtcaatttattaaataccaaagggaatcctgatggccacgtgattttacgtggcggtaaaaaacctaactttgaacaaaaatatgtaatggaatgtgaaactgcattacgtaaagcgggtttagaagaagcaataatgattgattgtagccacggtaattcaaataaagatcacacacgtcaacctatagttgcagaaaatgtactcacgcaattattggcaggtaaccgatcgatcatcggcttaatgattgaaagccatttaaatgcgggtaatcagccctctgaacaatcattccaagagatgaaatacggcatatccattacagatgcttgtattgattggcaaaccactgaacatatacttctcaacttcgccgcaaaattaagaaatcccccatcttcctttcagtaa

SEQ ID NO: 1186 - protein, 359 aa, Haemophilus ducreyi 35000HP
MDSVANQDSLHNVNISTEKVLLTPKQLKTEFPLPDHLRKQIEKSRQEIAAIIHKKDPRKLIIIGPCSIHDISAALEYGQKLKKLADQVSDQLYIVMRVYFEKPRTTVGWKGLINDPQIDGTFNVEAGLRIARKLCLDLTELGLPLATEALDPMTPQYLADLFSWSAIGARTTESQTHRELASGLSMAVGFKNGTDGGLAVAINAMQSAAQPHRFIGINQNGQVNLLNTKGNPDGHVILRGGKKPNFEQKYVMECETALRKAGLEEAIMIDCSHGNSNKDHTRQPIVAENVLTQLLAGNRSIIGLMIESHLNAGNQPSEQSFQEMKYGISITDACIDWQTTEHILLNFAAKLRNPPSSFQ

SEQ ID NO: 1187 - DNA, 1113 bp, Haemophilus ducreyi 35000HP
  CDS (1)..(1113): transl_table=11
atgccttataaaaatgatgatcttcgtatcactaaaattgaacagctattacccccgatcgctttattagagcgttttccagccagtgatgttgctgagcatactgttgctagagcaagagaagctattcataaaattattcacggtgaagacgatcgtttattagttgttattgggccttgctcaattcatgatccagaatctgctctagattatgctaaacgaattaaagcattacgtgataatccacagattaatcaaaacttagagttagtaatgcgcgtttattttgaaaaaccacgaacaaccgttggttggaaagggttaattaatgacccctatctgaatgaaacttatgcattaaacgatggtttacgaattgcacgaaaagtactgtccgatattaatgatttaaccgtgcctgccgcgggtgagtttttagatatgatcattccacaatatgtagccgattttatgagttggggagccattggagcacggaccgctgaatcacaagttcatcgtgagttagcctcaggtttatcttgtgcggtaggtttcaaaaatgccactaatggcagtgttaaaaccgctttagatgcaataaaatctgctgaagtttcacatcacttcttatccgtgaccaaatttgctcattcagctgttatttctaccgcaggtaatgaggattgccacattattttgcgtggtggcgataatggcacaaattatgatattgcgtctgtaaaaaaagtgtgtgcagatattgagaaagcagggcggcgtcctcacgtaatgattgactttagtcatgctaatagccaaaaacaatttaaacgacaaatggaagtttgtactaatgtatgccaacagattgcaaatggttcatcattaatttctggtgtgatgatagaaagccatttagtcgaaggtcggcaagatcttgtcgaaggtggtttagataaattagtatatggtcaaagtgttacagatgcttgtattggttgggaagacagcgaaacagcactgtttgccttagctgaagcggtcgcattacgccgacaacggaccaacaataatgctaatgatttggttaatcatatagtaaaatag

SEQ ID NO: 1188 - protein, 370 aa, Haemophilus ducreyi 35000HP
MPYKNDDLRITKIEQLLPPIALLERFPASDVAEHTVARAREAIHKIIHGEDDRLLVVIGPCSIHDPESALDYAKRIKALRDNPQINQNLELVMRVYFEKPRTTVGWKGLINDPYLNETYALNDGLRIARKVLSDINDLTVPAAGEFLDMIIPQYVADFMSWGAIGARTAESQVHRELASGLSCAVGFKNATNGSVKTALDAIKSAEVSHHFLSVTKFAHSAVISTAGNEDCHIILRGGDNGTNYDIASVKKVCADIEKAGRRPHVMIDFSHANSQKQFKRQMEVCTNVCQQIANGSSLISGVMIESHLVEGRQDLVEGGLDKLVYGQSVTDACIGWEDSETALFALAEAVALRRQRTNNNANDLVNHIVK

SEQ ID NO: 1189 - DNA, 1074 bp, Prochlorococcus marinus subsp. marinus str. CCMP1375
  CDS (1)..(1074): transl_table=11
atgaccttttcaacgaattttcagatatctgataaaacttccgatctacacgttgttgagactaggccattagtccctccagcttcccttcacaaggatttgccattagatcatcactcttcaaccattgtttctaagacaagaaaaacaatacaagcaattctggcaggatcagattcacgattattggtaattgttggcccttgttcaattcatgatattgctgctgccaaagattatgcaaatcagctgcttccgctaagagaaaaattttctaagcaactcgaaattgtaatgagagtttattttgaaaaacctaggacaactactggttggaagggtctcattaatgatcctcatcttgatgggtcttatgacattaatactggtttaagaagagcgagatctttgcttctagatttagcaaatttaggtattccaacagcaactgagcttttagatcctgttgttcctcaatatatagctgatttaattagttggactgcaattggggcaagaacgactgagagtcaaactcatagagaaatggcttccggattatctatgccaataggatataagaatggaacagatgggactattgctattgctattaatgctatgaaagcagcttcaaagcctcatcattttctaggtattaatcatgaaggccatgcatctattattagtacgacaggcaaccctgatggtcatcttgttttgagagggggaagtagtggtactaattatcatctggaatcagtgcaaaaagttgctcaagaacttctacaatcaggctcaaaaagtaaagtgatggttgactgtagtcacggtaactcagataaggattttcgaaaacaaggtattgtcttgaaagaggttgctaagcaggttaaagaaggttcgtctaatgtcatgggagtgatgcttgagagccatttggttgaaggtaatcaaaaattaactaaggacttatcaacattgatttatggaaaaagtattacagatgcctgtatagatttgaagacgacagaaactttgtttgagcaacttgctgatgctgttactttttaa

SEQ ID NO: 1190 - protein, 357 aa, Prochlorococcus marinus subsp. marinus str. CCMP1375
MTFSTNFQISDKTSDLHVVETRPLVPPASLHKDLPLDHHSSTIVSKTRKTIQAILAGSDSRLLVIVGPCSIHDIAAAKDYANQLLPLREKFSKQLEIVMRVYFEKPRTTTGWKGLINDPHLDGSYDINTGLRRARSLLLDLANLGIPTATELLDPVVPQYIADLISWTAIGARTTESQTHREMASGLSMPIGYKNGTDGTIAIAINAMKAASKPHHFLGINHEGHASIISTTGNPDGHLVLRGGSSGTNYHLESVQKVAQELLQSGSKSKVMVDCSHGNSDKDFRKQGIVLKEVAKQVKEGSSNVMGVMLESHLVEGNQKLTKDLSTLIYGKSITDACIDLKTTETLFEQLADAVTF

SEQ ID NO: 1191 - DNA, 1086 bp, Candidatus Blochmannia floridanus
  CDS (1)..(1086): transl_table=11
atgcaaaagaataatttaggtaatataaatttttgtgatataagttctttgctttctcctaaacaattaaaatctcaatttcctttaacgtatgttgatcaactttttattgaagaaacacaaaatattattataaatattattcaaaaaaaagatcctcgtttgttgattatatgtggtccttgttctattcatgatgtgaacgctgcttttgattatgccaagaaattaaaatctttatcattagaattgcaagatcaattatatattgtaatgagagtatatttagaaaaacctcgtactacaattggatggaaaggattaattaatgatccttatatagatggttcttgtgatattcagtctggattaaaaattgctcgtcaattattattgcaattaataaaaattaaattgcctgtagcgactgaaatattaaatccaaatgttcctcaatatattggagatttatttagttgggtagctattggggctcgtactacagagtcacagatacatcgagaaatagcttctagttttcagtcggtaataggttttaaaaatagtactcatggagatattgatcatgcaattaatgcaatacgtgcagcttccatgtctcataattatattagtattgatcaatctgggcaggtgtgttcattacatactaaaggaaatacaaatagtcatataattttaagaggagggattcaacctaattattatccagaaaatattatttgttgtgaaaaaaaaataacagaaatagggttacctataacattaatgatcgattgtagtcatggtaattctaataaggattatcatcgtcaaatagatgtagctcaatctattttaaatcaaataaagttgggtaatcattctattataggattaatgatggaaagttatatttatcctggaaatcaaatagtagatttgacgcatacttcttctattaaaatgcagtatggggtatctataacagatgcttgtatagattgggattcaactgaacgattattaagatgcttacataaagaattgaaaccatttctttctactcgtttaaaaagagtatga

SEQ ID NO: 1192 - protein, 361 aa, Candidatus Blochmannia floridanus
MQKNNLGNINFCDISSLLSPKQLKSQFPLTYVDQLFIEETQNIIINIIQKKDPRLLIICGPCSIHDVNAAFDYAKKLKSLSLELQDQLYIVMRVYLEKPRTTIGWKGLINDPYIDGSCDIQSGLKIARQLLLQLIKIKLPVATEILNPNVPQYIGDLFSWVAIGARTTESQIHREIASSFQSVIGFKNSTHGDIDHAINAIRAASMSHNYISIDQSGQVCSLHTKGNTNSHIILRGGIQPNYYPENIICCEKKITEIGLPITLMIDCSHGNSNKDYHRQIDVAQSILNQIKLGNHSIIGLMMESYIYPGNQIVDLTHTSSIKMQYGVSITDACIDWDSTERLLRCLHKELKPFLSTRLKRV

SEQ ID NO: 1193 - DNA, 1119 bp, Bordetella parapertussis 12822
  CDS (1)..(1119): transl_table=11
ttgacccgtatcgatgacccgctgcacgatcgcgaggccggccaggccgacgcgacgcaagacaccacccgcatcgacgacgtgcgcatcggcgccgtgcgtcccctgatttcgcccgccctgctgcaggacgaactgccggtatcggcgccgctacaggcgctggtcgaggacagccgcgcgcgcatcgccgacgtgctgcacggccgcgacgaccggctggtggtggtggtcggcccctgctccatccacgaccacgaacaggccatggagtacgcgcgccagctcaaggaggcgaccgacacgctggccgacgacctgctcatcgtcatgcgcgtgtacttcgagaagccgcgcaccaccgtgggctggaagggctacatcaacgatccgcgcctggacggcagtttccgcatcaacgaaggcctgcgccgcgcgcgccacctgctgctggaaatcggcgccctgggactgcccatcgccaccgaattcctggacctgctcagcccgcaatacatcgccgacctgatcgcctggggcgcgatcggcgcgcgcaccaccgaaagccccagccaccggcaactggcctcgggcctgagctgcccgctgggtttcaagaacggcaccgacggcggcatccaggtggcggccgacgccatcgtggccgccagcgccccgcatgccttcatgggcatgaccaagatgggcaccgccgccatcttcgagacgcgcggcaacgacgacacccacgtcatcctgcgcggcggcaagcaaggccccaactacgacgcggccgccatcgacgcctgctgtgcggcgctggccaaggccggcctgcgcgagcaggtcatggtcgactgctcgcacgccaattcgaacaagtcgcacgcgcgccaggtcgacgtggcgcgcgacctggcccggcagctggccggcggcgaccgccgcatcatcggcatcatgatcgaaagcaacctcgaggaaggccgccaggatctcaagcccggcgtgccgctcaagcgcggcgtgtccatcaccgacgcctgcctgagctgggcccagaccgagccggtgctggccgagctggcccaggccgtgcgccagcgccgcgaaggctga

SEQ ID NO: 1194 - protein, 372 aa, Bordetella parapertussis 12822
MTRIDDPLHDREAGQADATQDTTRIDDVRIGAVRPLISPALLQDELPVSAPLQALVEDSRARIADVLHGRDDRLVVVVGPCSIHDHEQAMEYARQLKEATDTLADDLLIVMRVYFEKPRTTVGWKGYINDPRLDGSFRINEGLRRARHLLLEIGALGLPIATEFLDLLSPQYIADLIAWGAIGARTTESPSHRQLASGLSCPLGFKNGTDGGIQVAADAIVAASAPHAFMGMTKMGTAAIFETRGNDDTHVILRGGKQGPNYDAAAIDACCAALAKAGLREQVMVDCSHANSNKSHARQVDVARDLARQLAGGDRRIIGIMIESNLEEGRQDLKPGVPLKRGVSITDACLSWAQTEPVLAELAQAVRQRREG

SEQ ID NO: 1195 - DNA, 1074 bp, Bordetella parapertussis 12822
  CDS (1)..(1074): transl_table=11
gtgtcgcacaataccgatgactttcgtatccgtgaaatcaaagagctgaatcctcctgcgcatgtcatgcgcgagtttccgtgctcgaaggatgtttctgaaatcgtctacgccgcccgccagggcatgcatcgcatcctgcatggcatggatgaccgcctgatcgtcgtgatcggcccttgctcgatccacgataccaaggcggcgctcgaatacgcggatcgcctcaagccggtgcgcgaccgcctggccgccgatctcgaggtggtgatgcgcgtctacttcgaaaagccgcgcaccaccgtgggctggaagggcctgatcaacgaccccgacctggatggcagcttcgatatcaacaagggcgtgcgcgtggcgcgcgaactgctgctggacatcaacagccgcggcctgccggcgggttgcgagttcctcgacatgattaccccgcagtacatcgccgacctggtgtcgtggggggcgatcggggcgcggacgaccgaaagccaggttcaccgcgagctggcttccggcctgtcgtgtcctgtcggtttcaagaacggcaccgacggcaatgtgaagatcgccgtcgacgccatcaaggccgcctcgcaaccgcaccatttcctctcggtgaccaagggcgggcattcggccatcgtctcgaccgcgggcaacgaggactgccacgtcattctgcgcggcggcaaggcgcccaactacgatgccgccagcatcgaagcggcctgccaggacatggccaaggccggcctggcccagcgcatcatgatcgacgccagccacgccaacagcagcaagaaacccgagaatcagccgctggtggtcgatgatgtggccaaccagatcgagcagggcgatgcccgcatcgtgggcctgatgatagaaagccatctgctgggcggccgccaggacctggtgcccggccaggccttgacgtacgggcagagcatcaccgacggttgcatcgactgggatgcttcggtgcaggtgctggagcgcctggcccatgcggtgcgcgaacgccggcgcgcgtcgctgagcgccggcaagtag

SEQ ID NO: 1196 - protein, 357 aa, Bordetella parapertussis 12822
MSHNTDDFRIREIKELNPPAHVMREFPCSKDVSEIVYAARQGMHRILHGMDDRLIVVIGPCSIHDTKAALEYADRLKPVRDRLAADLEVVMRVYFEKPRTTVGWKGLINDPDLDGSFDINKGVRVARELLLDINSRGLPAGCEFLDMITPQYIADLVSWGAIGARTTESQVHRELASGLSCPVGFKNGTDGNVKIAVDAIKAASQPHHFLSVTKGGHSAIVSTAGNEDCHVILRGGKAPNYDAASIEAACQDMAKAGLAQRIMIDASHANSSKKPENQPLVVDDVANQIEQGDARIVGLMIESHLLGGRQDLVPGQALTYGQSITDGCIDWDASVQVLERLAHAVRERRRASLSAGK

SEQ ID NO: 1197 - DNA, 1074 bp, Bordetella bronchiseptica RB50
  CDS (1)..(1074): transl_table=11
gtgtcgcacaataccgatgaccttcgtatccgtgaaatcaaagagctgaatcctcccgcgcatgtcatgcgcgagtttccgtgctcgaaggatgtttctgaaatcgtctacgccgcccgccagggcatgcatcgcatcctgcatggcatggatgaccgcctgatcgtcgtgatcggcccttgctcgatccacgataccaaggcggcgctcgaatacgcggatcgcctcaagccggtgcgcgaccgcctggccgccgatctcgaggtggtgatgcgcgtctacttcgaaaagccgcgcaccaccgtgggctggaagggcctgatcaacgaccccgacctggatggcagcttcgatatcaacaagggcgtgcgcgtggcgcgcgaactgctgctggacatcaacagccgcggcctgccggcgggttgcgagttcctcgacatgattaccccgcagtacatcgccgacctggtgtcgtggggggcgatcggggcgcggacgaccgaaagccaggttcaccgcgagctggcttccggcctgtcgtgtcctgtcggtttcaagaatggcaccgacggcaatgtgaagatcgccgtcgacgccatcaaggccgcctcgcaaccgcaccatttcctctcggtgaccaagggcgggcattcggccatcgtctcgaccgcgggcaacgaggactgccacgtcattctgcgcggcggcaaggcgcccaactacgatgccgccagcatcgaagcggcctgccaggacatggccaaggccggcctggcccagcgcatcatgatcgacgccagccacgccaacagcagcaagaagcccgagaatcagccgctggtggtcgatgatgtggccaaccagatcgagcagggcgatgcccgcatcgtgggcctgatgatagaaagccatctgctgggcggccgccaggacctggtgcccggccaggccttgacgtacgggcagagcatcaccgacggttgcatcgactgggatgcttcggtgcaggtgctggagcgcctggcccatgcggtgcgcgaacgccggcgcgcgtcgctgagcgccggcaagtag

SEQ ID NO: 1198 - protein, 357 aa, Bordetella bronchiseptica RB50
MSHNTDDLRIREIKELNPPAHVMREFPCSKDVSEIVYAARQGMHRILHGMDDRLIVVIGPCSIHDTKAALEYADRLKPVRDRLAADLEVVMRVYFEKPRTTVGWKGLINDPDLDGSFDINKGVRVARELLLDINSRGLPAGCEFLDMITPQYIADLVSWGAIGARTTESQVHRELASGLSCPVGFKNGTDGNVKIAVDAIKAASQPHHFLSVTKGGHSAIVSTAGNEDCHVILRGGKAPNYDAASIEAACQDMAKAGLAQRIMIDASHANSSKKPENQPLVVDDVANQIEQGDARIVGLMIESHLLGGRQDLVPGQALTYGQSITDGCIDWDASVQVLERLAHAVRERRRASLSAGK

SEQ ID NO: 1199 - DNA, 1119 bp, Bordetella bronchiseptica RB50
  CDS (1)..(1119): transl_table=11
ttgacccgtatcgatgacccgctgcacgatcgcgaggccggccaggccgacgcgacgcaagacaccacccgcatcgacgacgtgcgcatcggcgccgtgcgtcccctgatttcgcccgccctgctgcaggacgaactgccggtatcggcgccgctacaggcgctggtcgaggacagccgcgcgcgcatcgccgacgtgctgcacggccgcgacgaccggctggtggtggtggtcggcccctgctccatccacgaccacgaacaggccatggagtacgcgcgccagctcaaggaggcggccgacacgctggccgacgacctgctcatcgtcatgcgcgtgtacttcgagaagccgcgcaccaccgtgggctggaagggctacatcaacgatccgcgcctggacggcagtttccgcatcaacgaaggcctgcgccgcgcgcgccacctgctgctggaaatcggcgccctgggactgcccatcgccaccgaattcctggacctgctcagcccgcaatacatcgccgacctgatcgcctggggcgcgatcggcgcgcgcaccaccgaaagccccagccaccggcaactggcctcgggcctgagctgcccgctgggtttcaagaacggcaccgacggcggcatccaggtggcggctgacgccatcgtggccgccagcgccccgcatgccttcatgggcatgaccaagatgggcaccgccgccatcttcgagacgcgcggcaacgacgacacccacgtcatcctgcgcggcggcaagcaaggccccaactacgacgcggccgccatcgacgcctgctgtgcggcgctggccaaggccggcctgcgcgagcaggtcatggtcgactgctcgcacgccaattcgaacaagtcgcacgcgcgccaggtcgacgtggcgcgcgacctggcccggcagctggccggcggcgaccgccgcatcatcggcatcatgatcgaaagcaacctcgaggaaggccgccaggatctcaagcccggcgtgccgctcaagcgcggcgtgtccatcaccgacgcctgcctgagctgggcccagaccgagccggtgctggccgagctggcccaggccgtgcgccagcgccgcgaaggctga

SEQ ID NO: 1200 - protein, 372 aa, Bordetella bronchiseptica RB50
MTRIDDPLHDREAGQADATQDTTRIDDVRIGAVRPLISPALLQDELPVSAPLQALVEDSRARIADVLHGRDDRLVVVVGPCSIHDHEQAMEYARQLKEAADTLADDLLIVMRVYFEKPRTTVGWKGYINDPRLDGSFRINEGLRRARHLLLEIGALGLPIATEFLDLLSPQYIADLIAWGAIGARTTESPSHRQLASGLSCPLGFKNGTDGGIQVAADAIVAASAPHAFMGMTKMGTAAIFETRGNDDTHVILRGGKQGPNYDAAAIDACCAALAKAGLREQVMVDCSHANSNKSHARQVDVARDLARQLAGGDRRIIGIMIESNLEEGRQDLKPGVPLKRGVSITDACLSWAQTEPVLAELAQAVRQRREG

SEQ ID NO: 1201 - DNA, 1068 bp, Prochlorococcus marinus subsp. pastoris str. CCMP1986
  CDS (1)..(1068): transl_table=11
atgacgacttcatccaataatcaatctttagaaaaaacatctgatttgcatgttgttgaaacacgtccattaatacctccaagcaaacttcataatgatatacctttagattatacctctgcagaaactgtctctaatactagaagatcaatacaaaatattttgcacaataatgatcctcggattctagtcatagtgggaccatgttcaattcatgatattgaggctgctaaagattattcagaatatattcaggaatttagaaaaatttataaagataaattagaaattgtaatgcgagtatatttcgaaaaacccagaactacaattggttggaaaggattaataaatgaccctcatttagatggttcatatgacattaatacaggtttacgaagagcgagaaatttactatcttatttggcaacgcgtgggataccctctgctactgagttattagatccaattgttcctcaatatattgctgatttaatcagttggacagcaattggtgcaaggactaccgaaagtcaaactcatagagaaatggcttcaggattatccatgcctattggttttaaaaatggtactgatggttcttttagtactgctattaatgcgatgcagtcggcttcaaaatctcatcatttcttaggtgttaatgatcaaggttatgcttctattgtaaatacaaccggcaatccagatggacatatagttttaaggggaggttctaaaggagttaatttcgaaaatcaacatgtaaaaagtatttcttccgaattaaaagaaggtaatcttccttacaaagttatgattgattgtagccatggaaattctaataaagattacacaaagcaatctgatgtccttaaaaacgtagcaaatcagattaagaatggtgaaaaaaatattttaggagtaatgcttgaaagtcatctgaaggagggtaatcaaaaactttcaaatatgaaagatcttgaatatggtacgagtattactgatgcttgcataaatatagaaacaacgaaaaatttgcttcagattctatatgattcaattttgtaa

SEQ ID NO: 1202 - protein, 355 aa, Prochlorococcus marinus subsp. pastoris str. CCMP1986
MTTSSNNQSLEKTSDLHVVETRPLIPPSKLHNDIPLDYTSAETVSNTRRSIQNILHNNDPRILVIVGPCSIHDIEAAKDYSEYIQEFRKIYKDKLEIVMRVYFEKPRTTIGWKGLINDPHLDGSYDINTGLRRARNLLSYLATRGIPSATELLDPIVPQYIADLISWTAIGARTTESQTHREMASGLSMPIGFKNGTDGSFSTAINAMQSASKSHHFLGVNDQGYASIVNTTGNPDGHIVLRGGSKGVNFENQHVKSISSELKEGNLPYKVMIDCSHGNSNKDYTKQSDVLKNVANQIKNGEKNILGVMLESHLKEGNQKLSNMKDLEYGTSITDACINIETTKNLLQILYDSIL

SEQ ID NO: 1203 - DNA, 1083 bp, Prochlorococcus marinus str. MIT 9313
  CDS (1)..(1083): transl_table=11
atgaattctggcgaaatgaccaccacttccgacttgcatgtggtggatacgcggcccttggtgtcgccgctcttgcttcatcaggagctgccccttgatctagtggctctcaaaaccgttgcagatactcgtaagcgcatccaggcaattctgcgtggtgaggatccccgcttgctggtgattgttggtccctgctcggttcatgacattgcctctgcaagggactatgcccgtcagttggagccattgcgacagcgatatgccgcccagttggaggtggttttgcgggtctatttcgaaaaacctcgcaccacagttggctggaaaggtctcatcaatgatccccatctcgatggttcctatgacatcaacactggcttgaggcgtgcgcggtcgttgttgctcgaccttgctcgcgagggtatgccgacggccactgaattgctggatccggttgtgcctcaatacatcgctgatttgatcagttggacggcgattggagccagaaccactgagagtcagacccatcgggagatggcttctggattgtcaatgcccgtcggttacaaaaacggtaccgatggcagtgccaagattgcgatccatgcgatgcaggcagcatctagaccgcatcattttcttgggatcaatcggcagggtcaggcttcgattgtgcataccactggaaaccctgatggccatctcgtgttgcggggaggtaatggctgtaccaattaccatcccgaagcggtggaagaggttgcaaaagaattagtgaaggctggcttggttgatcggttgatggtggattgcagccatgacaattcgaagaaagattttcggcgacagtcagaggtgcttcaggctgttgctactcaggtacgccaaggatcaacccatctcatgggtgtgatgttggaaagtcatcttgtcgagggcaatcagaagttgcctgaagacctctctactcttgtctatggtcaaagcattacggatgcttgtatcgatatagagacaacggcaactctccttgaggatttggcggctgcagtggcttcagtgacgttgtcaccaataacttga

SEQ ID NO: 1204 - protein, 360 aa, Prochlorococcus marinus str. MIT 9313
MNSGEMTTTSDLHVVDTRPLVSPLLLHQELPLDLVALKTVADTRKRIQAILRGEDPRLLVIVGPCSVHDIASARDYARQLEPLRQRYAAQLEVVLRVYFEKPRTTVGWKGLINDPHLDGSYDINTGLRRARSLLLDLAREGMPTATELLDPVVPQYIADLISWTAIGARTTESQTHREMASGLSMPVGYKNGTDGSAKIAIHAMQAASRPHHFLGINRQGQASIVHTTGNPDGHLVLRGGNGCTNYHPEAVEEVAKELVKAGLVDRLMVDCSHDNSKKDFRRQSEVLQAVATQVRQGSTHLMGVMLESHLVEGNQKLPEDLSTLVYGQSITDACIDIETTATLLEDLAAAVASVTLSPIT

SEQ ID NO: 1205 - DNA, 1068 bp, Synechococcus sp. WH 8102
  CDS (1)..(1068): transl_table=11
atggccaccacctcggatttgcatgtggtggagacccgtccgctggtggctccggctctgctgcacggagatctgccgattgatgccgccgccacggagacggtcgcatcggcccgtcgtcggatccaggccattttgcgcggcgatgatcagcgtcagctggtggtggtgggcccctgctcggtccacgatgtgaaggcggcgcgggagtacgccgaacggctggccccgatccgggaacggctgaaggatcagctggaggtggtgatgcgggtttatttcgaaaagccgcgtacgacggttggttggaaaggcctcatcaatgacccccacctcgatggctcgtacgacatcaacacaggcctgaggcgggctcgtggcttactgctggacctgtccagggagggcatgccggcagcgacggaactgctggatccggtggttccccagtacatcgctgatctgatcagctggactgcgatcggagcccgcaccacggaaagccagacccatcgggagatggcttcaggcttgtcgatgccgatcggctacaagaacagtaccgatggcagcgcctgcatcgccatcaatgcgatgcaggcggcatcgaaacctcatcattttctgggaatcaaccacgacggccatgcctcgatcgtgagcacgactggcaacccggatggtcatctagtgctgcgtggcggtcatcagggcagcaactaccacctggaggccgttcaggctgctgcagcggaactgagcaaggcgggcctgaaggatcgtctgatggtggactgcagccatgccaactcgaacaaggatttccgccgccaggccgatgtactcgccacggtggctgatcagttgaaggctggttccggccatgtgatgggcgtgatgatcgaaagtcatctggtggaaggcaatcagaaactgaccgctggtctctcccagctcacctatggccagagcattacggatgcctgcatcagcctggagaccacggatgcgctgctgtcccagctggctgcagccgtggccgatcgcagcagcgctttgacggcataa

SEQ ID NO: 1206 - protein, 355 aa, Synechococcus sp. WH 8102
MATTSDLHVVETRPLVAPALLHGDLPIDAAATETVASARRRIQAILRGDDQRQLVVVGPCSVHDVKAAREYAERLAPIRERLKDQLEVVMRVYFEKPRTTVGWKGLINDPHLDGSYDINTGLRRARGLLLDLSREGMPAATELLDPVVPQYIADLISWTAIGARTTESQTHREMASGLSMPIGYKNSTDGSACIAINAMQAASKPHHFLGINHDGHASIVSTTGNPDGHLVLRGGHQGSNYHLEAVQAAAAELSKAGLKDRLMVDCSHANSNKDFRRQADVLATVADQLKAGSGHVMGVMIESHLVEGNQKLTAGLSQLTYGQSITDACISLETTDALLSQLAAAVADRSSALTA

SEQ ID NO: 1207 - DNA, 1059 bp, Chromobacterium violaceum ATCC 12472
  CDS (1)..(1059): transl_table=11
atgcaacgccagaccgacgacgtcagaatccgcgaaatcaaggaactgcttcccccgatcgcccacctttacgagctgccgatcagcgagtcggcctccgagctgatctacaacacccgtcgcgaaatctcggccttgctgcgcggcgaggacgaccgcctgctggtggtgatcggcccctgttccatccacgacgtcgacgccgcggtcgagtacgcgcagaagctggcgccgctgcgccaggcgctggcggatgagctggtggtggtgatgcgggtgtatttcgagaagccgcgcaccacggtcggctggaagggcctgatcaacgacccgcacctgaacgagtcctacgacatcaacgccggcctgcgcatcgcgcgccgcctgctgctgacgctgaacaacctgggcatgccggccgccaccgaattcctcgacatgatcacgccgcagtacttcgccgacctgatcagctggggcgcgatcggcgcccgcaccaccgagagccaggtgcaccgcgagctggcctccggcctgtcctgcccggtcggtttcaagaacggcaccgacggcaacctgaagatcgccgtcgacgccatccgctcgtccagcgtgccgcaccatttcctgtcggtgaccaagaccggccattccgccatcgtttccaccggcggcaacccggactgccacgtgatcctgcgcggcggcaaggaacccaattactcggccgagcatgtgcgcgccgccgccgccgagctgaccgcggtcggcctgccgcacaagctgatggtggacttcagccacgccaacagccgcaaggactaccgccgccagatggaggtcagcgccgacgtggccggccagatcgccggcggcgaccgcaacatcttcggcgtgatggtggaaagccacctggtggaggggcgccaggatcagaagcccggctgcgagctcaagtacggccagagcatcaccgacgcctgcctgggctgggacgacaccgagacgctgctgcgccagctggccgacgccgtcaaggcgcgccgcgccgccgagtaa

SEQ ID NO: 1208 - protein, 352 aa, Chromobacterium violaceum ATCC 12472
MQRQTDDVRIREIKELLPPIAHLYELPISESASELIYNTRREISALLRGEDDRLLVVIGPCSIHDVDAAVEYAQKLAPLRQALADELVVVMRVYFEKPRTTVGWKGLINDPHLNESYDINAGLRIARRLLLTLNNLGMPAATEFLDMITPQYFADLISWGAIGARTTESQVHRELASGLSCPVGFKNGTDGNLKIAVDAIRSSSVPHHFLSVTKTGHSAIVSTGGNPDCHVILRGGKEPNYSAEHVRAAAAELTAVGLPHKLMVDFSHANSRKDYRRQMEVSADVAGQIAGGDRNIFGVMVESHLVEGRQDQKPGCELKYGQSITDACLGWDDTETLLRQLADAVKARRAAE

SEQ ID NO: 1209 - DNA, 1107 bp, Chromobacterium violaceum ATCC 12472
  CDS (1)..(1107): transl_table=11
atgacaacgcttgccaggccggaacacggcctactcgcgcccgaacacggccacgcgtcgccgccgtccagccaggcggactaccgcgcgatggccagccccgccgaactattgcgcagcctgccggccggcccgcgcgccagcgcctcggtccattccggccgcgaggcggtgaaacgcgtactgagcggagcagatccgcgctggctggtggtggtgggcccctgctccatccacgacccgcgcgccggcctggactacgccgcccggctggcggacctcgcctccgagctggacgacacgctgctgatcgtgatgcgcgcctacttcgaaaagccgcgcaccagcgtgggctggaagggcctgatcaacgatccctacatggacgacagctattgcgtggacgagggcatgcacatcgcccgccgcttccttttggccgccgccgaactgggcctgccgctggccggcgaggcgctggacccgatgtcgccgctgtatctggccgacctctatagctggatggcgatcggcgcgcgcaccaccgaatcgcaaatccaccgcgagctggcctcggcgctggacagcgccgtcggattcaagaacagcaccgacggctcgctggacgcggcgctcaacgccatcgtctccgccagcgcgccgcacgcctacctcggcatgggcaaggacggccgggtggcggtggtgaacagccgcggcaacccgcactgccacctggtgctgcgcggcggcggcggccggcccaattacgactcggtgagcatcgcgctggccgagcaggcaatgaagaagcacgacattccgcccgccatcatggtggactgcgcgcacgccaactcatggaagcagcacacgctgcagccgcgcgtgctggccgacgcggtgtcccagatccgccacggcaaccgcagcatccgcgccttcatgctggagagcttcatcgaagccggcaaccagtccatcccggccgatctgtcgcagctgcgctacggctgctcggtgaccgatccctgcgtcgactggcacaccaccgccgacatcctgcgcgacgcgcgcgccaagctgcggccgctgctggaaagctga

SEQ ID NO: 1210 - protein, 368 aa, Chromobacterium violaceum ATCC 12472
MTTLARPEHGLLAPEHGHASPPSSQADYRAMASPAELLRSLPAGPRASASVHSGREAVKRVLSGADPRWLVVVGPCSIHDPRAGLDYAARLADLASELDDTLLIVMRAYFEKPRTSVGWKGLINDPYMDDSYCVDEGMHIARRFLLAAAELGLPLAGEALDPMSPLYLADLYSWMAIGARTTESQIHRELASALDSAVGFKNSTDGSLDAALNAIVSASAPHAYLGMGKDGRVAVVNSRGNPHCHLVLRGGGGRPNYDSVSIALAEQAMKKHDIPPAIMVDCAHANSWKQHTLQPRVLADAVSQIRHGNRSIRAFMLESFIEAGNQSIPADLSQLRYGCSVTDPCVDWHTTADILRDARAKLRPLLES

SEQ ID NO: 1211 - DNA, 1119 bp, Gloeobacter violaceus PCC 7421
  CDS (1)..(1119): transl_table=11
gtgcccggcggctctcgcgatgtcggcgagttcgcctttgagccgctcgacgatttgcggatcgtctcggtgagtgagattcctcctccagtgcaactgcgcgagcaattgcctctggatgcggctgcccagaatacagtgcgccggggccgctcgcagattcgcgctgtattgggcggctttgattcacgcctgttggtggtggtcggcccctgttcggtgcacgacgccgatgcggcgcgcgagtacgcccagaggctggccgagtgcgcccgccgctatgcggacgaactgctcatcgccatgcgcgtttacttcgagaaaccgcgcaccacggtcggctggaaaggactcatcaacgatcccggcctcgacggcagctgtcgtatcggtgagggactgaccaccgcccgcgcgttgctgctcgacattgcccggctcggactgccggcggccaccgaatttctcgacccgatcacccccgagtacatcgtcgatctgatcagttggggggcgattggggcgcgcacggtcgaaagtcaggtgcacaggcaagtggcttcggcgctttcctgtccggtgggttttaaaaacggctcctccggcgacatcgccgttgccgtcgaagcggtgctctcggcgcgcaacgcccatcagttcctttcgcacacccgcgagggtcgcacggctatcgtgctgaccagcggcaatcccgattgccatgtcgtgttgcgcggcggcaaaaacggccccaaccactcggctgaacatctcgcgcaggcagggcggttgttgcgcgaggcgggcttgccggagcgggtgatggtcgactgcagccacgccaacagctccaaagatcaccgccgccagggggaagtctgcaaacagttggcggcacggattgccgagggggatatgcggatgatgggcctgatgatcgaaagtcacctagtcgaagggcggcaggagttaggcgacggctgcaacttgcgccacggtcagagcatcaccgatgcgtgcatcggctgggaacagacagagcaattgcttaccggcctacacgaggcggccggcgctagacggtgtaagccggccgtccgcgccgagttgctggtttga

SEQ ID NO: 1212 - protein, 372 aa, Gloeobacter violaceus PCC 7421
MPGGSRDVGEFAFEPLDDLRIVSVSEIPPPVQLREQLPLDAAAQNTVRRGRSQIRAVLGGFDSRLLVVVGPCSVHDADAAREYAQRLAECARRYADELLIAMRVYFEKPRTTVGWKGLINDPGLDGSCRIGEGLTTARALLLDIARLGLPAATEFLDPITPEYIVDLISWGAIGARTVESQVHRQVASALSCPVGFKNGSSGDIAVAVEAVLSARNAHQFLSHTREGRTAIVLTSGNPDCHVVLRGGKNGPNHSAEHLAQAGRLLREAGLPERVMVDCSHANSSKDHRRQGEVCKQLAARIAEGDMRMMGLMIESHLVEGRQELGDGCNLRHGQSITDACIGWEQTEQLLTGLHEAAGARRCKPAVRAELLV

SEQ ID NO: 1213 - DNA, 1095 bp, Photorhabdus luminescens subsp. laumondii TTO1
  CDS (1)..(1095): transl_table=11
atgttcatgcaaagagatgcacttaataacgttcacatcagtggtgagcaaattcttatcaccccaaaagaattaaagcaacaatacccactgagtgatgatgatctgcatgttattgcaaatgcacgtaaaacaattgcggatattattcagcgccgtgatccccgtttgctggtagtgtgtggtccttgctctattcatgacgtggatgcggcgctggattatgctcaccgtttggccgctctttctgctgaattgagtgatagcttgtacattgtcatgcgtgtctattttgaaaagcctcgaacaacagtgggttggaaaggtcttattaatgatccatacatggatggttcatttgatgtggaagctggcctgcatattgcccgccgcttactacttagtttagtgaaaatgggattgcctcttgcaacagaagctttagatccgaatagcccacaatatttgggggatttattcagttggtctgcaattggtgcgagaaccacagaatcccagacacaccgggaaatggcttcaggtttatctatgccggttggtttcaaaaatgggactgacggtagcttgaacacggcaattaatgcgatgtgtgcagccgctatgccacatcgttttgtgggaataaaccagtcggggcaggtgtgtttattacaaacgcaaggaaacccgaatggacatattatcttgcgtggtggtaagacccctaattacagtgttcaacatgtaatggaatgtgaacagcaaatgatgcaggctggattattgccatccttgatgattgattgtagtcatggtaactctaataaggattttcgtcgccaaagtttggttgtagattctgttgcggatcagatcatttcaggtaatcaatctattactggcattatgttggagagccatattaatgaaggtaaccaatcttctgagcaaccgcgtagtgaaatgaaatatggtgtatcagtcactgacgcgtgtattagttggcagacgacagaagcagttctaagaaaattacatcagcaaattagcatgcaattgtcgcaaagaatggcagtattgaaaaaagcgggataa

SEQ ID NO: 1214 - protein, 364 aa, Photorhabdus luminescens subsp. laumondii TTO1
MFMQRDALNNVHISGEQILITPKELKQQYPLSDDDLHVIANARKTIADIIQRRDPRLLVVCGPCSIHDVDAALDYAHRLAALSAELSDSLYIVMRVYFEKPRTTVGWKGLINDPYMDGSFDVEAGLHIARRLLLSLVKMGLPLATEALDPNSPQYLGDLFSWSAIGARTTESQTHREMASGLSMPVGFKNGTDGSLNTAINAMCAAAMPHRFVGINQSGQVCLLQTQGNPNGHIILRGGKTPNYSVQHVMECEQQMMQAGLLPSLMIDCSHGNSNKDFRRQSLVVDSVADQIISGNQSITGIMLESHINEGNQSSEQPRSEMKYGVSVTDACISWQTTEAVLRKLHQQISMQLSQRMAVLKKAG

SEQ ID NO: 1215 - DNA, 1053 bp, Photorhabdus luminescens subsp. laumondii TTO1
  CDS (1)..(1053): transl_table=11
atgaattaccagaatgacgatataagaattaaagagataaaagaattattacctcctgtggcactacttgaaaaatttccagcaactgaaaaggctgcattgacagtatgtaaggcgcgtaaaacgattcatcaaattctgacgggtgaagatgagcgtctgttggtggtgattgggccatgttctattcatgatcctaaagcagcaatggaatatgccgggcggttgaatgaattgcgtgaagagctgaaagaggatctggaagttgtcatgcgagtttattttgaaaaaccgcgcacaactattggctggaaagggttaattaatgaccctcatatgaatcacagttttgatattaatgatggtttgcgtttagctcgtcagttgttacgggatattaatgatatggggctaccggctgcgggtgaatatctggatatgatttctccacagtatttagccgatttgatgagttggggagcaattggcgctcgtacaacggaatctcaggtccatcgtgagttggcttctggtctttcctgtccggttggttttaaaaatggtactgatggtgcgataaaagttgccattgatgcgattaatgcagcgggttcccctcacagtttcctttctgtcactaagtggggacattctgcgattgtaaataccagcggaaacaacgattgtcatattatcctgcgtggcggtaaagagccgaattacagttctgaacatgttgctgtcgtgaagcaaaacttggaaaaagcaggtttaccggcaagaattatgattgatttcagtcatgccaatagttctaagcaatttaaaaagcagatggatgtgtgttcagatgtgagccggcagcttattgctggggagaaagcgattattggtgtcatggtagaaagtcatttggaagagggaaatcagaacccggatagcggtctgccattggtatatggcaaaagtattactgatgcttgcattggttgggctgacactgaaattttgttacgtcaattgtcgtcggcaataaaagcgcgtcgtggctga

SEQ ID NO: 1216 - protein, 350 aa, Photorhabdus luminescens subsp. laumondii TTO1
MNYQNDDIRIKEIKELLPPVALLEKFPATEKAALTVCKARKTIHQILTGEDERLLVVIGPCSIHDPKAAMEYAGRLNELREELKEDLEVVMRVYFEKPRTTIGWKGLINDPHMNHSFDINDGLRLARQLLRDINDMGLPAAGEYLDMISPQYLADLMSWGAIGARTTESQVHRELASGLSCPVGFKNGTDGAIKVAIDAINAAGSPHSFLSVTKWGHSAIVNTSGNNDCHIILRGGKEPNYSSEHVAVVKQNLEKAGLPARIMIDFSHANSSKQFKKQMDVCSDVSRQLIAGEKAIIGVMVESHLEEGNQNPDSGLPLVYGKSITDACIGWADTEILLRQLSSAIKARRG

SEQ ID NO: 1217 - DNA, 1047 bp, Photorhabdus luminescens subsp. laumondii TTO1
  CDS (1)..(1047): transl_table=11
atgtacaaaacagatggtttaaggactcaccgtgtcgatagtttagtcacacctcaaactcttgcaattcaatttcctgtatccgaaaaaatcgtcaataatgtgacagcgtcacggaaacgtattgccgatattctcagcgggaatgatccacggcttatggtaatcatcggtccttgttctattcatgatattgatgctgctttagattatgctcagcgactgaacaggttacgtgaaaaataccagcacagactggaaattattatgcgcacctattttgagaaaccacgcacagtggtgggctggaaaggtttaatttcagacccctatctcgacggttcttgccaggtaaatcggggtattactttggcccggaaattattggttgatgtcaatgagttgggtttacccacagcaaccgaatttctggatatggtgaccggccaatatattgccgatctgatcagttggggcgcgatcggagccagaacaacagaaagccagattcaccgagaaatggcatctgccctctcctgtccagttggctttaaaaatggaacggatggcaacatccgtatcgccatagatgcaatccgcgcagccggggtctgtcacacattcctctcgccggataagcgcggtcagatgaccatctatcaaaccgaaggcaacccatacggccacattattatgcgtggaggcaaacagcctaattacagtgccaaagatattgctacagcttgtactcaactacgtgaatttaatttaccagaacatttagttatcgatttcagtcatggtaattgtcaaaaaattcataaacgccaactgactatagcaaaagaggtgggtcaccagattcaagagggttctaccgctattgtcggtgtaatggttgaaagttttctggttgaaggcacccagcaagtcattcagggacaaccgctaaattacggtcaatcgatcaccgatccttgtctaaactggcaagatacagaacagcttattgacattctcgccgaagcagtaagttaccgtttctga

SEQ ID NO: 1218 - protein, 348 aa, Photorhabdus luminescens subsp. laumondii TTO1
MYKTDGLRTHRVDSLVTPQTLAIQFPVSEKIVNNVTASRKRIADILSGNDPRLMVIIGPCSIHDIDAALDYAQRLNRLREKYQHRLEIIMRTYFEKPRTVVGWKGLISDPYLDGSCQVNRGITLARKLLVDVNELGLPTATEFLDMVTGQYIADLISWGAIGARTTESQIHREMASALSCPVGFKNGTDGNIRIAIDAIRAAGVCHTFLSPDKRGQMTIYQTEGNPYGHIIMRGGKQPNYSAKDIATACTQLREFNLPEHLVIDFSHGNCQKIHKRQLTIAKEVGHQIQEGSTAIVGVMVESFLVEGTQQVIQGQPLNYGQSITDPCLNWQDTEQLIDILAEAVSYRF

SEQ ID NO: 1219 - DNA, 1245 bp, Vibrio vulnificus YJ016
  CDS (1)..(1245): transl_table=11
ttgaaaaccaaagcgaggcgctttggtttttttataatgtgtaatttattttttacatttgatgttttttattgtttacggttgatttttaattcaaccctgttaacttgtgttcaaacagatttcgactctcagggatatgagggtgtaaaaaataatatacaggtgagtgtcatgcagaaaagtgaactaagcaatattaatatcagcgatgaacaagtgctgattacgccagaacagctaaaacagaaactgccactgagcgacaacgcccgccgcttcattcaagagtcgcgtaataccgtcgccaatattattcataagcaagatcatcgtctgctggtggtttgtggtccttgttctattcacgatctggacgcggcaaaggattatgcgcgtcgcctaaaagcgctctccgccgagttaagcgatcaactgtatattgtgatgcgtgtttactttgaaaaacctcgtacaactgtgggttggaaagggctcatcaacgaccctcatctggatggtagcttcgatattgagcatggtctgcatgttggccgtcaattgctggtggagctggctgaaatggagatccctctggcgacagaagcactcgacccaattagtccgcaatacttggctgatacattcagttgggctgcgattggtgcgcgtacgacagaatcacaaactcaccgtgaaatggccagtggtttgtctatgccgattggttttaaaaatggcacggatggcagcttgtcaacggcgattaacgcaatgcaagcggcctcttcaagccaccgttttatggggatcaaccgtgaaggccaagtggcattgctgacgactcaaggtaacccaaatggtcacgtgattttgcgtggtggtaagcagaccaactacgattctgtgtcggtggcggagtgtgagcaagacatggccaaagtgggtttagatgcgtcattgatggtggattgtagccatgccaattcgcgcaaagattaccgtcgtcagcctttagtcgccgaagacgtgattcatcaaattcgcgaaggcaacaaatcgatcattggtttgatgattgaaagccacattaatgaaggtaatcaatcctcagatttaccgctttctgagatgcagtacggtgtttctattaccgatgcctgtatcaattggcaggcaactgaggcactattgcgtaaagcacacaaagagttagtgccacatttagaaaaccgtctcaaataa

SEQ ID NO: 1220 - protein, 414 aa, Vibrio vulnificus YJ016
MKTKARRFGFFIMCNLFFTFDVFYCLRLIFNSTLLTCVQTDFDSQGYEGVKNNIQVSVMQKSELSNINISDEQVLITPEQLKQKLPLSDNARRFIQESRNTVANIIHKQDHRLLVVCGPCSIHDLDAAKDYARRLKALSAELSDQLYIVMRVYFEKPRTTVGWKGLINDPHLDGSFDIEHGLHVGRQLLVELAEMEIPLATEALDPISPQYLADTFSWAAIGARTTESQTHREMASGLSMPIGFKNGTDGSLSTAINAMQAASSSHRFMGINREGQVALLTTQGNPNGHVILRGGKQTNYDSVSVAECEQDMAKVGLDASLMVDCSHANSRKDYRRQPLVAEDVIHQIREGNKSIIGLMIESHINEGNQSSDLPLSEMQYGVSITDACINWQATEALLRKAHKELVPHLENRLK

SEQ ID NO: 1221 - DNA, 1053 bp, Vibrio vulnificus YJ016
  CDS (1)..(1053): transl_table=11
atgccactaaaaacagatgaattgagaacccaacctttgggtccaatgccaactcccgctgagttgagccaagcccatccgattaccgacgatgtggccgagcgaattgcgaaatctcgcagacaaattgaagatattttaacgggtaaggacaaccgtcttttggtgattgtcggtccttgctctgtgcacgatactgaagccgcgattgattacgcgacgcgtttaagctcgattcaagagcagtatcgcgatgagctgttcatcgttatgcgtacctactttgaaaaaccacgcactgtggtgggctggaaaggcctcattaccgacccaaatctggatggctcgtatgcgctagaagctggcctgcataaagcacgtaagctattgctcgatatcaacaaacttggccttgccaccgcaaccgagtttcttgacatgatcaccggtcaatatattgctgatttgatcacttggggcgcgattggagctcgaaccactgaatcgcaaattcaccgtgaaatggcgtctgcactctcctgcccggttggctttaaaaacggcaccaacggcaacgtgaaaattgcgattgacgcaattcgcgcatcaaaagcttcgcattacttctactctccagataaaaatggccgcatgaccgtttaccgcaccagtggtaacccatatggacatattattctgcgtggtggtgatacaggccctaactttgacgcaaaatcggttgagtctgcctgtcaatcactggctgagttcgatttgccacaacgtttgatcgttgatttcagtcacgctaactgtgaaaagcaacatcgtaaacagctcgatgtcgcgcaagacatttgtaaccaactaaaagcgggcagcacttatatcgcaggcatcatggcagaaagcttcattaccgaaggcaatcagccgatgactgaccttgataacttgacctacggccaatcgatcactgacccttgcctaagctgggaacacacagcgcaaatgctggacatgcttgcgactgctgtaaaagaaagccgttaa

SEQ ID NO: 1222 - protein, 350 aa, Vibrio vulnificus YJ016
MPLKTDELRTQPLGPMPTPAELSQAHPITDDVAERIAKSRRQIEDILTGKDNRLLVIVGPCSVHDTEAAIDYATRLSSIQEQYRDELFIVMRTYFEKPRTVVGWKGLITDPNLDGSYALEAGLHKARKLLLDINKLGLATATEFLDMITGQYIADLITWGAIGARTTESQIHREMASALSCPVGFKNGTNGNVKIAIDAIRASKASHYFYSPDKNGRMTVYRTSGNPYGHIILRGGDTGPNFDAKSVESACQSLAEFDLPQRLIVDFSHANCEKQHRKQLDVAQDICNQLKAGSTYIAGIMAESFITEGNQPMTDLDNLTYGQSITDPCLSWEHTAQMLDMLATAVKESR

SEQ ID NO: 1223 - DNA, 1053 bp, Vibrio vulnificus YJ016
  CDS (1)..(1053): transl_table=11
atgttccaaacagatgatgtaagaattaataacgttaaagagttacttccaccagtagctgttttagagaagtacccagcgactgaaaccgcttcttcgacaactttccaatcgagaaacgacattcacaacattctcatcggcaaggacgatcgcctgctggttattgtcggcccttgctctatccacgatcctgtggccgcggttgaatacggcaagcgtttgaaaacgttgcgtgacgatctcaaaggtgagcttgaaattgttatgcgcgtttactttgaaaagccacgtaccactgtgggttggaaaggtttgattaatgacccgtaccttaacgacacctacaagttgaatgatggtttacgcatgggccgaaaactgttgttggatcttaccgatatgggtcttccaacggcgagtgagttccttgacatgatcacaccacagtatgtggctgatttgatcagttggggtgctattggtgcacgtaccacggaatctcaggttcaccgtgaactggcgtcgggtctttcttgtccggttggttttaaaaatggcacggatggcaacattaagattgcaagtgatgcgattcgctcagcaagtgcttctcaccatttcctatcggtaacgaaatacggccattctgctatcgttgaaaccgcgggtaatccagactgccacattattttgcgtggtggtaaagagccaaactacagtgcagcgcatgtttcagcggtaaaagaagagttagctacatcgggtttgccacaaaaagtgatgatcgacttcagccacgccaacagctccaagcagtataagcgtcaaatgttggtcgccgacgatgtctctgagcagctagcggctggtgaagaggcaatctttggggtgatgatcgaatcacatcttgtggaaggtcgacaagatcttgttgatggtaaagcggcgacttatggtcagtcgattaccgacgcttgtatcggttgggaagatactgaaactgtgcttcgccaattggcaaatgcagtggcagctcgtcgagcaaaatag

SEQ ID NO: 1224 - protein, 350 aa, Vibrio vulnificus YJ016
MFQTDDVRINNVKELLPPVAVLEKYPATETASSTTFQSRNDIHNILIGKDDRLLVIVGPCSIHDPVAAVEYGKRLKTLRDDLKGELEIVMRVYFEKPRTTVGWKGLINDPYLNDTYKLNDGLRMGRKLLLDLTDMGLPTASEFLDMITPQYVADLISWGAIGARTTESQVHRELASGLSCPVGFKNGTDGNIKIASDAIRSASASHHFLSVTKYGHSAIVETAGNPDCHIILRGGKEPNYSAAHVSAVKEELATSGLPQKVMIDFSHANSSKQYKRQMLVADDVSEQLAAGEEAIFGVMIESHLVEGRQDLVDGKAATYGQSITDACIGWEDTETVLRQLANAVAARRAK

SEQ ID NO: 1225 - DNA, 1071 bp, Vibrio vulnificus YJ016
  CDS (1)..(1071): transl_table=11
atgcctacgctcagcaaattgattcactccactccttgtggaacactcccttctgtggaagagatcattcaacacgcctcactggacgaagagagcgaagcgtttatccgacaacgtcgccaagacatcactcgaattctaaatggccaagaccctcgattactggtgatcatcggcccatgttcaattcacgacccgcaagcaggcctagaatatgcgcagaaactggccaacattcagcatcagcatgaaaagcaacttctgattgtgatgcgaacttactttgaaaaaccacgcacacgcgcaggatggaaagggctgatcgtcgatcccgatctcgataacagccacgacattaataaaggtctgcggcttgctcgacatttcttacagcaagtcatcaagcttggcctcgcgacggcaaccgagtatttagacaccacgacttacccctatatttctgacctcatttgttggggggccattggcgcgaggacaactgaatctcaaattcaccgtcaaatggcctcggcgcttccctgccctattggtttcaaaaacgggaccgacggcaatgttgatattgctatcgacgcgatacacgcggcaaactcaccccatctcatctgtgtgccaggatttggggcacgtactctcacagccatcagtcatggtaaccccaatggccatatcattttgcgaggtggcaaaacaccaaactacaccaccgagcatgtttgccaaatcagccaacaactggaagccaacgatcttaacccgcgcctgatcattgattgcagccatggcaatagcctgaaagtggcaaagaaccaactcgatgtggcgagaaacatcgcctgtcagttgatcgaaggagaaaaatgcattgcaggcgtgatggcggagagcttcttggtagcaggcgcgcaaaagatcaccgatcgtccgttgatcaaaggcatgtcgattactgatgaatgtttggggtgggaagagacagaaagtattctcaatatttttgcggaagcggtgaatatcgtgatgacggagcgcttttccaccgttgcctaa

SEQ ID NO: 1226 - protein, 356 aa, Vibrio vulnificus YJ016
MPTLSKLIHSTPCGTLPSVEEIIQHASLDEESEAFIRQRRQDITRILNGQDPRLLVIIGPCSIHDPQAGLEYAQKLANIQHQHEKQLLIVMRTYFEKPRTRAGWKGLIVDPDLDNSHDINKGLRLARHFLQQVIKLGLATATEYLDTTTYPYISDLICWGAIGARTTESQIHRQMASALPCPIGFKNGTDGNVDIAIDAIHAANSPHLICVPGFGARTLTAISHGNPNGHIILRGGKTPNYTTEHVCQISQQLEANDLNPRLIIDCSHGNSLKVAKNQLDVARNIACQLIEGEKCIAGVMAESFLVAGAQKITDRPLIKGMSITDECLGWEETESILNIFAEAVNIVMTERFSTVA

SEQ ID NO: 1227 - DNA, 1095 bp, Rhodopseudomonas palustris CGA009
  CDS (1)..(1095): transl_table=11
gtgttgaccaccacagacgaccttcgccttcagaaaatcaccgagctgagtacgcctgccgaggtgatgggcgagattccgcgcacactgaccgcaacgcgtaccgttgcggcgagccgcagcgcgattcatgccatcctgaacggagccgacgaccggctcctcgtcgtcgtcggcccctgttcgattcacgatccggccgcagccatggactatgccagccgtctggcggcgctgcgcgagaccctggccgaccggctcgagatcgtgatgcgggtgtatttcgaaaagccgcgcaccacggtgggttggaagggactgatcaacgaccccgatctcgatggcagcttccggatcgacaaggggctacggttggcgcgggaagtactctcggccgtgaacaatctcggcctgccagcggcgaccgaattcctcgatctgatcacgcctcaatacatcgcggatctcgtcgcctggggcgcgatcggcgcgcgcaccaccgagagccagatccaccgcgaactcgcgtcaggcctgtcatgcccaatcggcttcaagaatggcaccgacggcaatgtccggatcgccgcggaggcggtgaagtccgcggcgcagccgcatcatttcatggcggtgaccaagggcgggcgcaatgcgatcgcggccaccactggtaacagcgactgccacgtcatcctgcgcggcggcgtcacaccgaactacgatgccgcaagtgtggaagccgccgcagcggtcctcggcaagatcggcctgccgccgcgcctgatgatcgacgccagccacgccaacagcagcaagcagccggacaaccagccgaaggtaacggccgatatcgggcgtcagatggcggctggcgagagccgcatcatcggcgtgatgatcgagagcaatctggtcgccggtcggcaggatgtggcgccgggtcggccgctgcaatacggccagagcatcaccgacggctgtatcgactgggcgacgaccgagacggtgctgcacgagctagccgatgcggtcgagagccggcgagctgcgcggcacgccgcaagcgctcagcagaaaggtgctgcggcgtga

SEQ ID NO: 1228 - protein, 364 aa, Rhodopseudomonas palustris CGA009
MLTTTDDLRLQKITELSTPAEVMGEIPRTLTATRTVAASRSAIHAILNGADDRLLVVVGPCSIHDPAAAMDYASRLAALRETLADRLEIVMRVYFEKPRTTVGWKGLINDPDLDGSFRIDKGLRLAREVLSAVNNLGLPAATEFLDLITPQYIADLVAWGAIGARTTESQIHRELASGLSCPIGFKNGTDGNVRIAAEAVKSAAQPHHFMAVTKGGRNAIAATTGNSDCHVILRGGVTPNYDAASVEAAAAVLGKIGLPPRLMIDASHANSSKQPDNQPKVTADIGRQMAAGESRIIGVMIESNLVAGRQDVAPGRPLQYGQSITDGCIDWATTETVLHELADAVESRRAARHAASAQQKGAAA

SEQ ID NO: 1229 - DNA, 1068 bp, Geobacter sulfurreducens PCA
  CDS (1)..(1068): transl_table=11
atgattcgcacgagcaacctgaagatcaaaagtattacccccatcattgcaccgggggaattacgccaggtgtttccccagtcggaggaggcggccgagttcgtcaactccagccgcgcccatatcaagaatatcctcaagggcaaggatccgcgcctgatggtggtggtgggcccctgttccattcacgatccgaaatcggctctggagtatgcggggcggctggcacgcctggcggccgaactgtcggatcagctattcatcgtgatgcgggtctacttcgaaaagccccgcactaccgtaggctggaagggactcatcaatgaccccgacatgaacggcacccatcagatatccaaggggctcggcatcgcccggcggctgctgtccgaaataacggaaatgctcctgccggtggcaaccgaaatgcttgaccccatcacgcccgactacctcgcggattgcatctcctggggagccatcggcgctcgtaccaccgagagccagacccaccgcgagatggccagcggcctctcgttccccgtgggattcaagaacggcaccgacggcaatctccagatagccatcgacgccatgaatgcggcactccattcccacagctttctcggcgtcaaccgggaggggcgcacctccatcattcagaccaccggcaaccccgatgtccacatcgtcctgcggggaggcaaaaaaccgaactatttccccgaagacatcagaaagaccgaagagatgctggaaaagggggggctcttccccaccatcatggtcgactgcagccacggcaactcggaaaaacgccacgagaagcagcccgacgtactctcttccgtcgtggaccagattgcggccggcaaccgctccatctccggcgtcatgatcgagagttttctggaagaagggaaccagtcgatccccagagatctctcaaccctcaagtacggcgtatccatcaccgacaagtgcattgactggaagaccaccgaaaccatcctgcgctcggcccacgaccgcctcaaggccgcgggaggcaggcccctgcacgggtaa

SEQ ID NO: 1230 - protein, 355 aa, Geobacter sulfurreducens PCA
MIRTSNLKIKSITPIIAPGELRQVFPQSEEAAEFVNSSRAHIKNILKGKDPRLMVVVGPCSIHDPKSALEYAGRLARLAAELSDQLFIVMRVYFEKPRTTVGWKGLINDPDMNGTHQISKGLGIARRLLSEITEMLLPVATEMLDPITPDYLADCISWGAIGARTTESQTHREMASGLSFPVGFKNGTDGNLQIAIDAMNAALHSHSFLGVNREGRTSIIQTTGNPDVHIVLRGGKKPNYFPEDIRKTEEMLEKGGLFPTIMVDCSHGNSEKRHEKQPDVLSSVVDQIAAGNRSISGVMIESFLEEGNQSIPRDLSTLKYGVSITDKCIDWKTTETILRSAHDRLKAAGGRPLHG

SEQ ID NO: 1231 - DNA, 1071 bp, Treponema denticola ATCC 35405
  CDS (1)..(1071): transl_table=11
atgataaaaaaccttattgacctccgaatcgagaggattcattgcataagttctcctgccgaaatggtagaaaaaatacccgcctcggattctctttattcttttatagccgaagcccgaaaaactatcagcaatataataaacggaaaggatgagcgttttttactcatagtcggcccctgctcgattcatgacacggaggcagccgaggattatgctatgcgcctattagagctaaaaaagaaatgctccgattctttctatattataatgcgtacctactttgaaaaacccagaaccgttttaggctggagaggccttatcgtagaacctgaacttgacggctttatcaatattgaaggcggcattcaaaagacaagaaaatttcttattaaacttgccgaaataggcattcctgcagcctccgaaatggtagaccctatgattccccaatacattgccgaccttgtaagctgggcttcgataggagcacgctcagccgaaagtcaaatccacagagaactggcctcaggactttcaatgccggtcggctttaaaaataccacctacggagacataacggccgctataaacggagttattgtttcccgcctgccccatgcctttgtaggcattgcccgaaacggactttcggcaatagtgcacacaaccggaaatcccgacactcacttggttttaaggggaggggtttcaaagcccaattataatagagaagaaattgaaaaagcagcctctcttatgaaggaaaaaatgctgaaaccgagcatagtaatagactgctcccacggaaattcgggaaaggacccgaaaaaacagataaacatctttgaagaaagcttaaaactccgcttcgataagaatgaacctcttgactatataaggggctgtatgattgaaagctttatccaagagggaagcacctcgatcgaaaaagcaaaggaacgcagcgaatacggtaaatccataaccgacccctgcctaggctgggaagaaactcaaacagaaatactaaaaatctatgaaaaatacaaaaggagaaagcaaaaatga

SEQ ID NO: 1232 - protein, 356 aa, Treponema denticola ATCC 35405
MIKNLIDLRIERIHCISSPAEMVEKIPASDSLYSFIAEARKTISNIINGKDERFLLIVGPCSIHDTEAAEDYAMRLLELKKKCSDSFYIIMRTYFEKPRTVLGWRGLIVEPELDGFINIEGGIQKTRKFLIKLAEIGIPAASEMVDPMIPQYIADLVSWASIGARSAESQIHRELASGLSMPVGFKNTTYGDITAAINGVIVSRLPHAFVGIARNGLSAIVHTTGNPDTHLVLRGGVSKPNYNREEIEKAASLMKEKMLKPSIVIDCSHGNSGKDPKKQINIFEESLKLRFDKNEPLDYIRGCMIESFIQEGSTSIEKAKERSEYGKSITDPCLGWEETQTEILKIYEKYKRRKQK

SEQ ID NO: 1233 - DNA, 1122 bp, Eremothecium gossypii
  CDS (1)..(1122)
atgttcattaaaaacgagtacattggtgacaaaagcaggctcgaggactggaggattaagggctacgacccactgactccgccgaatgtgctccagcacgagctacctgtcagtgcaaatgggcgcgcgataattgtacgggcacgcgagggggtggttcaagtgctttccggcagggatgaccggcttctggttgtggttgggccctgctccatccacgaccccgaggccgctctggaatacgcgcagaggcttagcgaggtggcctcgcggctgcgcggggagctgctggttattatgcgtgcgtatctggaaaaaccgcggaccacggtggggtggaaggggctcatcaacgaccccgacatcgataattcgttccaaataaacaagggattgcgtatctcgcgggagatgtacacgcagctggtggagcacattccaattgcgggcgaaatgctagacaccatatcgccgcagttcttaagcgactgcttctccttgggcgccattggcgcccggacgacagaatcgcagctgcaccgtgagctggcttctggactatcgttcccgatcggattcaagaacgggacagatggctgcttacaggttgctattgacgctatgcgtgccgctgctcactctcattactttctttcggttaccaagcctggagtgactgcgattgttgggactgaaggtaacgaggacaccttcatcattctacgcggtggtaaagatggcacaaactatgacgctgccagtgtacaacaggctaagcaggacttggtcaatgcgaagctagttgacagcgctggggtccagcggaggattatgattgactgctcgcatggaaattccaacaaggattaccgcaaccagccgaaagtcgcccaagatatctatgagcagctgagtaaaggtgagaatgccatttgtggggtgatgattgaatccaatcttgtagaggggcggcaggatatccccgaggggaacggtcgtgtgggcctaaagtatggttgttcgatcaccgacgcgtgcataggctgggatcaaacagtagaagtattagagctgcttgcaaagggcgtcataaacaagagagctgtaatgtcgacaaattaa

SEQ ID NO: 1234 - protein, 373 aa, Eremothecium gossypii
MFIKNEYIGDKSRLEDWRIKGYDPLTPPNVLQHELPVSANGRAIIVRAREGVVQVLSGRDDRLLVVVGPCSIHDPEAALEYAQRLSEVASRLRGELLVIMRAYLEKPRTTVGWKGLINDPDIDNSFQINKGLRISREMYTQLVEHIPIAGEMLDTISPQFLSDCFSLGAIGARTTESQLHRELASGLSFPIGFKNGTDGCLQVAIDAMRAAAHSHYFLSVTKPGVTAIVGTEGNEDTFIILRGGKDGTNYDAASVQQAKQDLVNAKLVDSAGVQRRIMIDCSHGNSNKDYRNQPKVAQDIYEQLSKGENAICGVMIESNLVEGRQDIPEGNGRVGLKYGCSITDACIGWDQTVEVLELLAKGVINKRAVMSTN

SEQ ID NO: 1235 - DNA, 1095 bp, Eremothecium gossypii
  CDS (1)..(1095)
atgacctcatttccgatgttcgcagcggacgctgaccaggccgaagacgtccgaatcctcggctacgaccctctggtgtcgccggcgctgcttcagtcgcaaattcccgcgacgcaggcgtgcctcgagacggcgcagaagggtcggcgggaggccatcgacatcataacagggaaggacgaccgggtgctggtggtggtcgggccgtgctcgatccacgacctggacgcggcgcaggagtacgcgcagcggctgaagaagctggcggaggagctggagggcgacctggtggtggtgatgcgcgcgtacctggagaagccgcggacgacagtggggtggaagggcctgatcaacgacccggacgtgaacaacactttcaacatcaacaagggcctacaggcggcgcggcagctgttcgtgaacctgacgtcgatcggcgtgccaattgggtccgagatgctcgacaccatctcgccgcagtacctcacggacctgctgtcgttcggcgctatcggcgcgcgcacgacggagtcgcaactgcaccgcgagctagcgtcggggctgtcgtttccgattgggttcaagaacggcacggacggctcgctggacgtggcactggacgcggtcaaggcgtcgtcccactcgcaccacttcatgggcgtgaccaagcacggcgtggccgccatcaccacgacgaagggcaacgagcactgctttgtcatcctgcgcggcggcaagcgcggcacgaactacgacgctacgtccgtggcggaggcgaaggccaagctgccccccacgggcgtgctgatgatcgactattcgcatgggaactccaacaaggacttccgcaaccagccgaaggtgaacgaggttgtgtcggagcagattgccaacggcgaggacaagatcgtcggcgtcatgatcgagtccaacatcaacgagggcagccagaagattccgcccgagggcaaagctggcctcaagtacggtgtttcgatcacggacggctgcatatcctgggagaccaccgaggaggtgctgaggaagctcgccggcgccgtccgcaagcggcgcgacctgcggaagaccaaataa

SEQ ID NO: 1236 - protein, 364 aa, Eremothecium gossypii
MTSFPMFAADADQAEDVRILGYDPLVSPALLQSQIPATQACLETAQKGRREAIDIITGKDDRVLVVVGPCSIHDLDAAQEYAQRLKKLAEELEGDLVVVMRAYLEKPRTTVGWKGLINDPDVNNTFNINKGLQAARQLFVNLTSIGVPIGSEMLDTISPQYLTDLLSFGAIGARTTESQLHRELASGLSFPIGFKNGTDGSLDVALDAVKASSHSHHFMGVTKHGVAAITTTKGNEHCFVILRGGKRGTNYDATSVAEAKAKLPPTGVLMIDYSHGNSNKDFRNQPKVNEVVSEQIANGEDKIVGVMIESNINEGSQKIPPEGKAGLKYGVSITDGCISWETTEEVLRKLAGAVRKRRDLRKTK

SEQ ID NO: 1237 - DNA, 1113 bp, Magnaporthe grisea 70-15
  CDS (1)..(1113)
atgtcgttcttcatcccaaacaagaatgttggcaacaaggaggaaagtgaagactggaggatccgtggatacaaccctctcacgtctcccgatctcctccaacatgagatcagtcagacccccgagtctaggcagacggtgatgcagggccgcgaggaggcagctgctgttgtcaacggcaacgaccccatgaacaggttgctcgtcatcgtcggcccgtgctccatccatgacccagaagccgcccttcagtactgcgacatgctggtcaaggagaaggagaagcacaaggacgagctgctcatcgtcatgcgagcctacctggaaaagccccggacgaccgtcggctggaagggtctcatcaacgacccggatatcgacaacagcttcaagattaacaagggtctcaagatgtcccgccagctgtttgtcgacctcaccagcaaggggatgccgatcgcttcggagatgcttgacaccatctcaccccagttcctcgccgatctcctttctgcaggcgcagtcggtgcccgcaccaccgagagccagcttcaccgcgagctggcctctggcctatcgttccccgtcggcttcaagaacggcaccgacggcacactgggcgtcgccatcgacgctatcggcgccgttaagcacccccaccacttcttgtcggtgaccaagccgggcgtggtggccatcgtgggcacagtcggcaacgaggactgcttcgtgatcctgcgcggcgggaaaaagggcaccaactatgacgccaagagcatcggcgaggccaaggaggctctggtcaaggccgggctcaggccgcgcctcatggtcgactgcagccatggcaactcgctcaaggaccaccgcaaccagcccaaggtctcccacgagctggccgaacagatcaaggcgggcgaggatgccatcatgggcgtcatgatcgagagcaacatcaatgagggcagccagaaggtgcccaaggagggcaaggctgggctgaagcacggcgtcagcatcacggatgcgtgcatctcatggcaggacaccgttacggtgcttgacgagctcgctgctgctgtcaagcagaggcgggaggctgcgcaaaagtaa

SEQ ID NO: 1238 - protein, 370 aa, Magnaporthe grisea 70-15
MSFFIPNKNVGNKEESEDWRIRGYNPLTSPDLLQHEISQTPESRQTVMQGREEAAAVVNGNDPMNRLLVIVGPCSIHDPEAALQYCDMLVKEKEKHKDELLIVMRAYLEKPRTTVGWKGLINDPDIDNSFKINKGLKMSRQLFVDLTSKGMPIASEMLDTISPQFLADLLSAGAVGARTTESQLHRELASGLSFPVGFKNGTDGTLGVAIDAIGAVKHPHHFLSVTKPGVVAIVGTVGNEDCFVILRGGKKGTNYDAKSIGEAKEALVKAGLRPRLMVDCSHGNSLKDHRNQPKVSHELAEQIKAGEDAIMGVMIESNINEGSQKVPKEGKAGLKHGVSITDACISWQDTVTVLDELAAAVKQRREAAQK

SEQ ID NO: 1239 - DNA, 1152 bp, Magnaporthe grisea 70-15
  CDS (1)..(1152)
atgtccaacggaacgaacatggtgccggcccaggtcgtctttgacgataccagagtcctgggtcaggaccctctgatccctccccagatcttgatggaggagatcccgatcaccaaagccgccctcgagacagtcgttcgcggtcgccaggaggccgtcgcttgcgtcattggccgtgacgaccgccttctcgttatcgttggaccctgctcgattcacgacccggcagcggccctcgaatactgccaacgcctcaaggccctggccgacaagctctcagatgacctctgcatcgttatgcgcgcctacctcgaaaagcccaggaccacggtgggctggaagggtctgatcaacgaccccgatatcgaccagaccttcaagatcaacaagggactgcgcatttcgcgacagatcttctgcgacctgacctcggccggtatgcccatcgccagcgagatgctcgataccatttctcctcagttcctggccgatctgatctcggttggtgctatcggcgcccgcacgaccgaaagccaattgcaccgagagttggcatctggtctttcgttccccgtgggattcaagaatggaacggacggtaacctcggtgtcgcgattgatgccatcggagctgccgcctcaaagcactcatttatgggtgtgacaaagcagggtctggctgccatcacccggacggcgggcaaccaacatggtttcgtcatcctgaggggtggtaccaagggtcccaactttgacaaggctagtgttcaggccgccaaggagacacttgtccagaagggccagaggcaggccattatgattgactgctcgcatggcaattccaacaaggaccaccgcaaccaacccaaggttgccaaggtcattggtgaccagctgcgcgagggtgagaggtccatcattggtgtcatgatcgagtccaacatcaacgagggcaaccagaaggtgccggctgaaggcccgtccggcctcaagaagggcgtcagcatcacggacgcctgtatcgactgggacagcacagtcgctgtcctagaggatctggctgatgcggtacgagcgcggaggagtctttaccccaatgaccgcaacgttgacagggaggagaggctcgcaactcctcttgaggaggactaa

SEQ ID NO: 1240 - protein, 383 aa, Magnaporthe grisea 70-15
MSNGTNMVPAQVVFDDTRVLGQDPLIPPQILMEEIPITKAALETVVRGRQEAVACVIGRDDRLLVIVGPCSIHDPAAALEYCQRLKALADKLSDDLCIVMRAYLEKPRTTVGWKGLINDPDIDQTFKINKGLRISRQIFCDLTSAGMPIASEMLDTISPQFLADLISVGAIGARTTESQLHRELASGLSFPVGFKNGTDGNLGVAIDAIGAAASKHSFMGVTKQGLAAITRTAGNQHGFVILRGGTKGPNFDKASVQAAKETLVQKGQRQAIMIDCSHGNSNKDHRNQPKVAKVIGDQLREGERSIIGVMIESNINEGNQKVPAEGPSGLKKGVSITDACIDWDSTVAVLEDLADAVRARRSLYPNDRNVDREERLATPLEED

SEQ ID NO: 1241 - DNA, 1128 bp, Gibberella zeae PH-1
  CDS (1)..(1128)
atgtcttcctctttctttatcccaaacaagaatgttggcaaccaagctgactctgaagattggagaatccgtggttacaaccctttgactcccccagacctgctccaacacgaaatctcccaatcccccgaatctaaaaagacggtcctcgaaggacgcaatgaaactgtcgctattgtcaatggcaccgacgagaagaaccgattgctcgttgtcattggcccatgttccatccacgaccccgcggctgcccttgcctactgcgacctcctcttgaaggagaaggagaagcataaggatgagcttcttatcgttatgcgatcctaccttgagaagccgcgcacaactgtcggctggaagggtttgatcaacgaccccgatattgatggcagctttaagatcaacaagggtctgcgcatctctcgacagctctttgttgacttgactgccaagggcatgcctatcgccagcgaaatgctggatactatctcaccccagttccttgctgatctactgtcagtcggtgccattggcgctcgtacaactgagagccagctccaccgtgaacttgccagtggcctgagtttccctgtgggtttcaagaacggcactgatggttctctgggcgtcgctattgatgccattggtgcggcccagcatcctcaccatttcctctcagtcaccaagcctggtgttgtcgccattgttggtaccgagggcaacaacgactgcttcgttatcctccgaggtggtaccaagggcaccaacttcgatgctgagaacattgctcttgccaaggaggcgcttcagaagaagggcgttcgacagagagttatgattgactgcagccacggaaactcttccaaggatcacaagaaccagcccaaggttgctgctgatatcgctggtcagatctccaagggcgaggatggcatcatgggagtcatgatcgagagcaacatcaacgagggtaaccaaaaggttcccgccgagggcaagtccgggcttaagtacggcgtcagcatcactgatgcctgtattagctgggaggacaccatctctacgctcaacactcttgcgcaggcagtaaaagaccgccgcaagcttgccagctcaaatggtgcctaa

SEQ ID NO: 1242 - protein, 375 aa, Gibberella zeae PH-1
MSSSFFIPNKNVGNQADSEDWRIRGYNPLTPPDLLQHEISQSPESKKTVLEGRNETVAIVNGTDEKNRLLVVIGPCSIHDPAAALAYCDLLLKEKEKHKDELLIVMRSYLEKPRTTVGWKGLINDPDIDGSFKINKGLRISRQLFVDLTAKGMPIASEMLDTISPQFLADLLSVGAIGARTTESQLHRELASGLSFPVGFKNGTDGSLGVAIDAIGAAQHPHHFLSVTKPGVVAIVGTEGNNDCFVILRGGTKGTNFDAENIALAKEALQKKGVRQRVMIDCSHGNSSKDHKNQPKVAADIAGQISKGEDGIMGVMIESNINEGNQKVPAEGKSGLKYGVSITDACISWEDTISTLNTLAQAVKDRRKLASSNGA

SEQ ID NO: 1243 - DNA, 1098 bp, Gibberella zeae PH-1
  CDS (1)..(1098)
atgccttcagctactatcgacatgtctaccatcgctgccgatgacaccagagtcctcggacaggatcccttgatccctcctgctctcctcacctccgaaatccctctccccgagaaggccacaaacaccgttgtcaagggccgtcaagatgctgccgacattgtccttggccagagcgacagacttctcgtcgttgtcggcccctgttccattcacgaccctgctaccgcccaggaatacgctgcccgactcaaggaggtctctgacagactcgacaaggatctctgcatcgtgatgcgcgcctacctcgagaagccccgaacaaccgttggctggaagggtcttatcaacgaccccgatatcgacaactccttcaagatcaacaagggtctccgtgtttcccgccagctgttcgtcgacctgaccacccagggtctgccaatcgccactgagatgcttgacaccatttctcctcagttccttgctgactgtatctctgttggcgctattggtgcccgtaccaccgagtcccagcttcaccgtgagcttgcctctggtctttctttccccgttggtttcaagaacggtacagacggtagccttaacgttgccattgacgctattggcgccgccgccgctcagcaccacttcatgggtgttaccaagcagggccttgctgctatcaccagaaccaagggtaacgagcactgcttcgttattctccgtggaggaaccaagggtaccaactttgacaaggacagcgtccagaatgccaagaaggtcctccaggacaagaagcagaaggaggctatcatgattgactgctcccacggaaactcttccaaggaccaccgaaaccaacccaaggttgccaaggtcgttggtgagcagctccgtgagggtgagaaggccattattggtgtcatgatcgagtccaacattggcgagggcaaccaaaaggtccccgccgagggccctgccgctctcaagcgcggtgtcagcatcactgatgcttgcattggctgggaggacaccgtcaccgtcctcgaggacctggctgatgctgtccgcactcgtcgcaagctcaacacagcctag

SEQ ID NO: 1244 - protein, 365 aa, Gibberella zeae PH-1
MPSATIDMSTIAADDTRVLGQDPLIPPALLTSEIPLPEKATNTVVKGRQDAADIVLGQSDRLLVVVGPCSIHDPATAQEYAARLKEVSDRLDKDLCIVMRAYLEKPRTTVGWKGLINDPDIDNSFKINKGLRVSRQLFVDLTTQGLPIATEMLDTISPQFLADCISVGAIGARTTESQLHRELASGLSFPVGFKNGTDGSLNVAIDAIGAAAAQHHFMGVTKQGLAAITRTKGNEHCFVILRGGTKGTNFDKDSVQNAKKVLQDKKQKEAIMIDCSHGNSSKDHRNQPKVAKVVGEQLREGEKAIIGVMIESNIGEGNQKVPAEGPAALKRGVSITDACIGWEDTVTVLEDLADAVRTRRKLNTA

SEQ ID NO: 1245 - DNA, 1071 bp, Candida glabrata CBS 138
  CDS (1)..(1071)
atgtctgatgcgaatgctaacgaagacgtgagaatcctgggctacgacccgctggtgtcgcctgcgctgctgcaggtgcaagtgccagccacagaggtgtctatccagaccgctaggcgcgggaggaaagagtccatcgagatcatcaccggccgtgacgaccgtgtgctcgtgatcgtcggaccttgctcggttcacgacctcgacgccgcgcaggagtacgcgcagaggctgaagaagctgtccgacgagctgcagaaggacctgtgcatcgtgatgagagcgtacctggagaaaccaagaaccacggtcggctggaaagggttgatcaacgaccctgacgtcaacaacaccttcaacatcaacaagggcctgcagagcgccagacagctgttcgtgaacttgaccaacaccggtgtccctatcggctctgagatgctggataccatctccccacagtacctcgcagacctgctctccttcggtgccatcggcgcaagaaccaccgagtcccaactgcacagagaactggcatcaggtctgtccttccctatcggcttcaagaacgggaccgacggtaccttgggcgtcgccgtagacgcctgccaggccgcatcccactcccaccacttcatgggtgtcaccaagcatggtgtcgccgccatcaccaccaccaagggtaacgagcactgcttcgtcatcctgagaggtggtaagaaaggtaccaactacgacgccaagtccgtcgccgaggccaagaaacagctaccggagggcgcaaacggcctgatgatcgactactcccacggtaactccaacaaggacttcagaaaccagccaaaggtcaacgacgccgtctgcgagcaaatcgccaacggtgaaaaggccatcgtcggtgtcatgatcgagtccaacatcaacgagggcaaccagtgcatcccaccagaaggtaaggccggcctaaagtacggtgtctccatcacggatgcctgtatctcctgggaaaccaccgaagacgtcttgagaaagttggctgccgccgtcagacaaagaagagaacactacaaataa

SEQ ID NO: 1246 - protein, 356 aa, Candida glabrata CBS 138
MSDANANEDVRILGYDPLVSPALLQVQVPATEVSIQTARRGRKESIEIITGRDDRVLVIVGPCSVHDLDAAQEYAQRLKKLSDELQKDLCIVMRAYLEKPRTTVGWKGLINDPDVNNTFNINKGLQSARQLFVNLTNTGVPIGSEMLDTISPQYLADLLSFGAIGARTTESQLHRELASGLSFPIGFKNGTDGTLGVAVDACQAASHSHHFMGVTKHGVAAITTTKGNEHCFVILRGGKKGTNYDAKSVAEAKKQLPEGANGLMIDYSHGNSNKDFRNQPKVNDAVCEQIANGEKAIVGVMIESNINEGNQCIPPEGKAGLKYGVSITDACISWETTEDVLRKLAAAVRQRREHYK

SEQ ID NO: 1247 - DNA, 1119 bp, Candida glabrata CBS 138
  CDS (1)..(1119)
atgttcatcaagaatgactacagaggtgacagaacccgtctagaagactggagaatcaaaggttacgatccattgactcctcctgatcttcttcagcatgaatacccaatcagtgagaaaggtgctgccaacatactgaaagctagagattctgtgtgtgacatcttgaatggtaaggatgaccgtatggttattgtcattggtccatgctccattcatgacccaaaggcagcttacgaatacgccgataagctagcagtaatcgctgagaagctatccgatgatctacttattatcatgagagcgtacttagagaagccaagaaccaccgttggatggaagggtctgataaatgacccagatattgataactctttccaaatcaacaaaggtttaagaatctcaagagaaatgttcacaaagctgatcgaaaagcttcctattgccggtgaaatgttagacactatctccccacaattcttgagtgactgtttctctctaggtgccattggtgccagaacaactgaatcccaactgcatagagaactagcttcaggtctatctttcccaattggtttcaagaatggtaccgatggtggcctacaagttgccatcgatgctatgagagctgcatctcacgaacattacttcctttctgtcacaaagcctggtgtcaccgctattgttggtactgaaggtaactccgacacttttatcattttaagaggtggtaagcatggtaccaactacgatgctgaaaatgtgaagtccaccaaagaacaactaaggaaagcaaaattgattgatgaagctgacagtaccagaagaataatgattgactgttctcacggtaacagtaataaggactacagaaatcaaccaaaggtcgctcaagagatctacaaccaactgagtgctggtgaaaacggtttgtgtggtgttatgatcgaatctaacctagtggaaggcagacaagatgttcctccagaaggtggtcgtgagggtctaaaatatggttgctctatcactgatgcttgtattggctgggatactaccgaaagcgttttggaacttctagccgaaggtgttagaaacagaagaaagcatttatccaagtaa

SEQ ID NO: 1248 - protein, 372 aa, Candida glabrata CBS 138
MFIKNDYRGDRTRLEDWRIKGYDPLTPPDLLQHEYPISEKGAANILKARDSVCDILNGKDDRMVIVIGPCSIHDPKAAYEYADKLAVIAEKLSDDLLIIMRAYLEKPRTTVGWKGLINDPDIDNSFQINKGLRISREMFTKLIEKLPIAGEMLDTISPQFLSDCFSLGAIGARTTESQLHRELASGLSFPIGFKNGTDGGLQVAIDAMRAASHEHYFLSVTKPGVTAIVGTEGNSDTFIILRGGKHGTNYDAENVKSTKEQLRKAKLIDEADSTRRIMIDCSHGNSNKDYRNQPKVAQEIYNQLSAGENGLCGVMIESNLVEGRQDVPPEGGREGLKYGCSITDACIGWDTTESVLELLAEGVRNRRKHLSK

SEQ ID NO: 1249 - DNA, 1095 bp, Kluyveromyces lactis NRRL Y-1140
  CDS (1)..(1095)
atgtcacaaactccaacacctatgttccatgaacaagaagatgtcagaatcttgggttacgatccattggtttcaccagctctccttcaggcccaagttcctgcctctcaagagtgtctagaaactgcgcaaaagggtagaaaagagtcaattgacatcatcactggtaaagacgacagagttctggttgttgttggtccatgttccatccatgacttgaaagaagcgcaagactacgctaagggattaaaggctttgtctgacgaactaaaaggtgatttatgtattataatgagagcttacttggaaaagccaagaactactgttggttggaaaggtttgatcaacgatccagatgtggataacacttacaacattaacaagggtttgcaagtctctagacaattgtttgtgaatttgactagtttaggtttgccaattggttccgaaatgttggacaccatttctccacaatacttggccgatttgttgtccttcggtgccattggtgccagaaccactgaatcacaattgcatagagaactagcatccggtttgtctttcccagtaggtttcaagaacggtaccgatggtaccttgggtgttgcattggacgctgttcaagctgcctctcactctcaccatttcatgggtgtcaccaagcacggtgtcgctgctattaccaccaccaagggtaacgaacactgtttcgtcattctaagaggtggtaagcaaggtaccaactacgacagtgtttctgtcgcagaagccaagaaagctctacctccaaccggtgttctaatgattgattactctcacggtaattctaataaagacttcagaaaccaaccaaaggttaacgacgccgtttgcgaacaaatcgctaacggtgaagacaaaatcatcggtgtcatgattgaatcccacatcaacgaaggtaagcaatctattccagcggaaggtaaagctggtttgaaatacggtgtttctatcacagatggatgtataagtttggaaacaactgctgaagtactaagaaaattggctgcagcagttagagcaagaagagaactaaaaaagaagaacactgaataa

SEQ ID NO: 1250 - protein, 364 aa, Kluyveromyces lactis NRRL Y-1140
MSQTPTPMFHEQEDVRILGYDPLVSPALLQAQVPASQECLETAQKGRKESIDIITGKDDRVLVVVGPCSIHDLKEAQDYAKGLKALSDELKGDLCIIMRAYLEKPRTTVGWKGLINDPDVDNTYNINKGLQVSRQLFVNLTSLGLPIGSEMLDTISPQYLADLLSFGAIGARTTESQLHRELASGLSFPVGFKNGTDGTLGVALDAVQAASHSHHFMGVTKHGVAAITTTKGNEHCFVILRGGKQGTNYDSVSVAEAKKALPPTGVLMIDYSHGNSNKDFRNQPKVNDAVCEQIANGEDKIIGVMIESHINEGKQSIPAEGKAGLKYGVSITDGCISLETTAEVLRKLAAAVRARRELKKKNTE

SEQ ID NO: 1251 - DNA, 1119 bp, Kluyveromyces lactis NRRL Y-1140
  CDS (1)..(1119)
atgttcatcactaacgatcatattggggacagaagtagtttagaagactggagaatcaagggatatgatccattgaccccaccggacttattacaacatgaatatcccatcggtgaaaaggccaaaaagatcatcgttgaagctagagagaaagtatgtgacattttgaatgggaaggacgaccgtttagttgtagttattgggccatgttctattcatgatccaaaggctgcctacgaatacgcagaccttttgaagaaaatttctgatgaattatccgatgatctattaatcattatgagagcgtacttggagaaacctagaaccactgttggctggaaaggtttgatcaatgatccagatatcgataattctttccaaattaacaaaggtttaagaatttctagagagatgttcaccagattgactgaaaaattaccaatcgctggtgaaatgttggacaccatttctccacaatttttgagtgactgtttctctctgggtgctatcggcgctagaaccactgaatctcaactacatagggaattagcttctggtctttctttcccaattggttttaagaatggtactgacggtggtctccaagttgctgttgatgccatgagatctgctgcacactcacattacttcttgtctgttactaaacctggtgtcactgccatcgttggaacagaaggtaacgaagatacctttgttatcttaagaggtggtaagactggaactaatttcgatgctgaaaacgtaaaaaagacgcaagccgaattggtcaaggcaaaggttgctgatgctgaaggtgtccaaagaagaatcatggttgattgttctcatgggaattcaaagaaagatttcagaaatcaaccaaaggtggctcagtcactttacgaacaactatcagctggtcaaaatgctatctgtggtgtcatgatcgaatctaacttagtcgaaggtagacaagacgttcctccagaaggtggccgtgaaaagttgatttacggatgttctatcaccgatgcctgtatcggttgggaaacaactgaagatgttctaagattattggcaaagggtgttaaaaacagaagagctctttcaaaggcttga

SEQ ID NO: 1252 - protein, 372 aa, Kluyveromyces lactis NRRL Y-1140
MFITNDHIGDRSSLEDWRIKGYDPLTPPDLLQHEYPIGEKAKKIIVEAREKVCDILNGKDDRLVVVIGPCSIHDPKAAYEYADLLKKISDELSDDLLIIMRAYLEKPRTTVGWKGLINDPDIDNSFQINKGLRISREMFTRLTEKLPIAGEMLDTISPQFLSDCFSLGAIGARTTESQLHRELASGLSFPIGFKNGTDGGLQVAVDAMRSAAHSHYFLSVTKPGVTAIVGTEGNEDTFVILRGGKTGTNFDAENVKKTQAELVKAKVADAEGVQRRIMVDCSHGNSKKDFRNQPKVAQSLYEQLSAGQNAICGVMIESNLVEGRQDVPPEGGREKLIYGCSITDACIGWETTEDVLRLLAKGVKNRRALSKA

SEQ ID NO: 1253 - DNA, 1107 bp, Debaryomyces hansenii CBS767
  CDS (1)..(1107)
atgagtaaaacaccaatcccagacgaatacgatgataccaggattttaggatacgatcctttgataccacctgcgttattacagcacgaaatcagagcaagtaaagaatcattggacgttgtgatcagaggacgtattgaatcatcagagattataagcggaaaggatgaccgttgtttggtcattgttggaccatgttctatccatgacactgaagcagcattggaatatgctaccagattgaagaagttgtcgttggaattggaaaatgacttagtaattgtcatgagagcatacttggaaaagccaagaactaccgttggttggaaagggttgatcaacgacccagatgtggacaactcgtttgatatcaacagagggttaagaatctcccgtcagttatactctgatttgaccggcaagactggcttaccaattggttccgagatgttggataccatttctccacaatacttctcagactttttgagttttggtgctattggtgctagaaccaccgagtcgcaattacaccgtgagttagcatctggtttatctttcccaattggtttcaagaatggtaccgatggtaacttaggcgttgccttagatgctgttcaagcgtcttctaagggtcaccacttcatgggtgtcaccaagaatggtactgctgccattactactaccaagggtaacgaaaactgtttcatcatcttgagaggtggtaagaagattaccaactacgaccctgaatctgtcgctgccgcaaaggaagccatcaacaagagtaccgatccaaatatcaagttgatggttgattgctctcatgataattctcaaaaagactacagaaaccaacctaaggtaatggaaagtgttgttgaccaaatctctaagggtgaaaacgctcttatcggtgtcatgattgaatctcacattaatgaaggtaaacaaagcatgccaggtccaaaagaagacaagagcgctttgaagtacggtgtctctatcactgatggatgtgttggttgggaaactactgttgaattattgcacaacttgagtaaggccgtgcaagaaagaagacaaattaataagtctaaagcttaa

SEQ ID NO: 1254 - protein, 368 aa, Debaryomyces hansenii CBS767
MSKTPIPDEYDDTRILGYDPLIPPALLQHEIRASKESLDVVIRGRIESSEIISGKDDRCLVIVGPCSIHDTEAALEYATRLKKLSLELENDLVIVMRAYLEKPRTTVGWKGLINDPDVDNSFDINRGLRISRQLYSDLTGKTGLPIGSEMLDTISPQYFSDFLSFGAIGARTTESQLHRELASGLSFPIGFKNGTDGNLGVALDAVQASSKGHHFMGVTKNGTAAITTTKGNENCFIILRGGKKITNYDPESVAAAKEAINKSTDPNIKLMVDCSHDNSQKDYRNQPKVMESVVDQISKGENALIGVMIESHINEGKQSMPGPKEDKSALKYGVSITDGCVGWETTVELLHNLSKAVQERRQINKSKA

SEQ ID NO: 1255 - DNA, 1122 bp, Debaryomyces hansenii CBS767
  CDS (1)..(1122)
atgttcattactaacgaacacgtcggagatcgttctagattagaagattggagagtccgtggctacgacccattgactcctcctgatttattacaacacgaactcccattgcctcaaaaatcacaagataccatcttaaaaggtagagaggctgcttgtgatatattgaatgggaaggatgatcgtttgattattgtcattggtccttgttcaatccatgatcctaaagctgctcttgagtatgctggaaaattgtacgaagctgctcaaaaatattctggtgaattgcatatcgttatgagagcatacttagaaaaaccgagaactacagttggctggaaggggttaattaatgatccagaaatcgatggttcgttccaaattaacaaaggtttgagaattgccagaaaattattcgtagaattgacagacaaattgccgattgccggcgaaatgttggatacaatttcgccccaattcttgtccgatttattctctcttggtgccatcggtgcaagaactactgagtcacaattgcatcgtgagttatcttccggcttatccttcccagttggtttcaaaaatggtacagatggtactttaggtgtagcaatggatgcagttagagctgcttctcatcctcaccactttttgtcagttaccaagcctggtattgttgctattgttggaacagatggtaatcaagactgttttgttattttaagaggtggtaagaagggtacaaatttcgatgaacaatctgtaaaggagactaaggcagaattaatcaagaataagatcgttacggaagaaaagtcaggtccaaggattatggttgattgttcccatggtaactcaagcaaaaatcacagaaatcaaccgttggttgcggccgaaatttccagacaaatcagtaatggggaggatggtatttgtggtttgatgattgaatcaaatcttgtcgaaggtagacaagatgtaccacctgctgataaaggtggtaaggatgctttgaagtatggttgttctattaccgatgcttgcatcggttgggaagataccgaatctgttttagaaggtttatctaatgccgtgaagcaaagaagaaattcaagaaagtaa

SEQ ID NO: 1256 - protein, 373 aa, Debaryomyces hansenii CBS767
MFITNEHVGDRSRLEDWRVRGYDPLTPPDLLQHELPLPQKSQDTILKGREAACDILNGKDDRLIIVIGPCSIHDPKAALEYAGKLYEAAQKYSGELHIVMRAYLEKPRTTVGWKGLINDPEIDGSFQINKGLRIARKLFVELTDKLPIAGEMLDTISPQFLSDLFSLGAIGARTTESQLHRELSSGLSFPVGFKNGTDGTLGVAMDAVRAASHPHHFLSVTKPGIVAIVGTDGNQDCFVILRGGKKGTNFDEQSVKETKAELIKNKIVTEEKSGPRIMVDCSHGNSSKNHRNQPLVAAEISRQISNGEDGICGLMIESNLVEGRQDVPPADKGGKDALKYGCSITDACIGWEDTESVLEGLSNAVKQRRNSRK

SEQ ID NO: 1257 - DNA, 1089 bp, Yarrowia lipolytica CLIB122
  CDS (1)..(1089)
atgcccgctatgcacaacgcttctaacgctcagggagaccgaaaccggaccgaggactggcgaatccggggctacaaccctctcacagcccccgatctgctccagcatgagatccctctgaccaagcagtccaaggccaccattctcaagggccgacaggacgcctgtgatattctggatggtaaggacgaccgaatcattgttgtggttggcccctgttccatccatgaccccaaggctgccatggagtacgccgagcgactcaagcagatctctgacaagctgtctggcgagcttctgatcgtcatgcgagcctacctcgaaaagcctcgaaccaccgttggctggaagggccttattaatgatcctgacatggacggctctttcaagatcaacaagggcctgcgagtcgctagagatctcttcgtgaagctcaccgagctcaaccccattgcttctgagcttctggacaccatttctccccagttcctggctgatctcttctctgtcggagccattggtgctcgaaccaccgagtcccagcttcaccgagagcttgcctctggtctgtctttccccgttggtttcaagaacggtactgacggaggtattaaggtggctctggacgccatccaggccgccgcccacccccaccacttcctttccgtcaccaagcccggtgtggttgccattgtcggcaccgacggaaacgaggactgcttcctgattctgcgaggaggttccaagggccccaactacgatgctgagcacgtcgccgaggtcaagaagcaggttggagagaccaagggtccccgaatcatggtagactgctcgcacggcaactcatcaaagaaccacaagaaccagcctctggtcgcctctaacgtggctcagcagattgctgctggtgagaagtccatttgcggtcttatgattgagtccaacatccacgagggtcgacaggacatctgcgataacaaggaggacatgaagtacggtgtgtctgtcaccgatgcctgcatcaactgggaggacactgagaaggtgctcgaggagctggcccaggccgtcaagactcgacgaggttag

SEQ ID NO: 1258 - protein, 362 aa, Yarrowia lipolytica CLIB122
MPAMHNASNAQGDRNRTEDWRIRGYNPLTAPDLLQHEIPLTKQSKATILKGRQDACDILDGKDDRIIVVVGPCSIHDPKAAMEYAERLKQISDKLSGELLIVMRAYLEKPRTTVGWKGLINDPDMDGSFKINKGLRVARDLFVKLTELNPIASELLDTISPQFLADLFSVGAIGARTTESQLHRELASGLSFPVGFKNGTDGGIKVALDAIQAAAHPHHFLSVTKPGVVAIVGTDGNEDCFLILRGGSKGPNYDAEHVAEVKKQVGETKGPRIMVDCSHGNSSKNHKNQPLVASNVAQQIAAGEKSICGLMIESNIHEGRQDICDNKEDMKYGVSVTDACINWEDTEKVLEELAQAVKTRRG

SEQ ID NO: 1259 - DNA, 1074 bp, Yarrowia lipolytica CLIB122
  CDS (1)..(1074)
atgtcccgttcctcctctcccaacgcctcctctgctgaggacgtgcgaattctgggctacgaccccctcctcgctcccgctcttctccagactgaggttgcctccaccaaaaacgcccgagagaccgtctccaagggccgaaaggactccattgatgtcatcaccggcaagtccgacaagttgctgtgcattgtcggtccctgctccctccacgaccccaaggccgccatggagtacgcccagcgactcaaggagctgtctgacaagctgtctggtgagctcgtcatcgttatgcgagcctacctcgagaagccccgaaccaccgttggctggaagggtctgatcaacgaccccgacatggacgagtctttcaacatcaacaagggtctgcgactctcccgaaaggtcttctgcgaccttaccgacttgggtctgcccattgcctccgagatgctcgataccatttctccccagttcctggccgacctgctctccctgggtgccattggtgctcgaaccaccgagtcccagctgcaccgagagctcgcctccggtctgtctttccccgttggtttcaagaacggaaccgacggtactctgggtgttgccgttgatgctgtccaggccgcctctcaccctcaccacttcatgggtgtcaccaagcagggtgttgccgccatcaccaccaccaagggtaacgagaactgcttcatcattctgcgaggaggtaagaagggcaccaactacgacgccgagtccgtcgccgagtgcaagaaggccaccgagtccatgctcatggttgactgctctcacggcaactccaacaaggactaccgaaaccagcccaaggtttccaaggccgttgctgagcaggttgctgctggcgagaagaagatcatcggtgtcatgatcgagagtaatatccacgagggcaaccagaaggtccccaaggagggcccctctgcccttaaatacggtgtctccatcaccgacgcctgtgtctcttgggagaccaccgtggacatgctcaccgagctggccaacgccgtcaaggagcgacgaaacaagaactaa

SEQ ID NO: 1260 - protein, 357 aa, Yarrowia lipolytica CLIB122
MSRSSSPNASSAEDVRILGYDPLLAPALLQTEVASTKNARETVSKGRKDSIDVITGKSDKLLCIVGPCSLHDPKAAMEYAQRLKELSDKLSGELVIVMRAYLEKPRTTVGWKGLINDPDMDESFNINKGLRLSRKVFCDLTDLGLPIASEMLDTISPQFLADLLSLGAIGARTTESQLHRELASGLSFPVGFKNGTDGTLGVAVDAVQAASHPHHFMGVTKQGVAAITTTKGNENCFIILRGGKKGTNYDAESVAECKKATESMLMVDCSHGNSNKDYRNQPKVSKAVAEQVAAGEKKIIGVMIESNIHEGNQKVPKEGPSALKYGVSITDACVSWETTVDMLTELANAVKERRNKN

SEQ ID NO: 1261 - DNA, 1143 bp, Aspergillus nidulans FGSC A4
  CDS (1)..(1143)
atgtcctccgaactcatcatatcgcagttcttccttccaaatcctaatttaggagatagcaatcaccttgaggattcaagaatccgcggatacaaccctctcacaccacccaacctcctgcaacatgagattgctctaacagagaaagcgcggcaaacggtccttcaaggccgagccgaggccattgccgtcgcccacggcacagacacagacaagcgccgcctcctcgtcgtcattggaccctgctcaattcacgaccccgaaatggccttagagtactgcgaccggctattgaaattgaaggagaaatacaaggatgagttgctaattgttatgcgctcttatctggagaagccccgaacgaccgtcggttggaagggcctcatcaacgacccggatatcgacaacagcttcaacatcaacaagggcctgcgcatctcgcgtcagctcttcgtcgacttgaccaacaagggaatgccaattgccagtgagatgctggacactatctccccgcagtttctggcggactgtctctccgtcggtgcggtcggcgcacggacaaccgaatcgcaggtccatcgtgaattggcctctgggctctcgttccccgttggcttcaagaacggtacagatggctcgttagacgtcgcggttgatgcgattggatccgtaaaacaccctcatcacttcctgtccgtcaccaagcctggtgttgtcgccattgtcggtaccgttggcaatcctgattgctttgttatcctccgcggcggcaagaaagggccgaactacgatgctgctagcatcaccgaagcaaaggagaagctcatagctaagggtctggcaccccgtctgatggtcgactgcagccacggcaactcacaaaaggatcacaagaaccagcctaaggtggcagctgttcttgcggagcagattgctgcaggcgaaaccgcaatcatgggcgtcatgatagagagtaatatcaacgagggcaaccaaaaggtcccacccgagggcaaggccggcctcaaatacggcgtcagtatcaccgacgcctgtatcaattgggaagacaccgagtcaacgctagagacccttgcaaaggctgttgcgactcggagagaaaagctcgcccccagttcatag

SEQ ID NO: 1262 - protein, 380 aa, Aspergillus nidulans FGSC A4
MSSELIISQFFLPNPNLGDSNHLEDSRIRGYNPLTPPNLLQHEIALTEKARQTVLQGRAEAIAVAHGTDTDKRRLLVVIGPCSIHDPEMALEYCDRLLKLKEKYKDELLIVMRSYLEKPRTTVGWKGLINDPDIDNSFNINKGLRISRQLFVDLTNKGMPIASEMLDTISPQFLADCLSVGAVGARTTESQVHRELASGLSFPVGFKNGTDGSLDVAVDAIGSVKHPHHFLSVTKPGVVAIVGTVGNPDCFVILRGGKKGPNYDAASITEAKEKLIAKGLAPRLMVDCSHGNSQKDHKNQPKVAAVLAEQIAAGETAIMGVMIESNINEGNQKVPPEGKAGLKYGVSITDACINWEDTESTLETLAKAVATRREKLAPSS

SEQ ID NO: 1263 - DNA, 1089 bp, Aspergillus nidulans FGSC A4
  CDS (1)..(1089)
atgagcggtcaaaacgaagatacccgcgtcctgggttacgaccctctgctttcgcctgagtttgttcagtccgagattccttctaacgagcactccattcctacggtccgctctggccgcaaccaggctgtcgaaattattgaacagcgcgatgaccgccttctagtggtcgttggcccttgctccatccacgatcccgaaaccgccctcgaatatgccactcgtcttaaggaacttgctgctcgtctctcctccgacctctgcgtcatcatgcgcgcctacctcgaaaagccccgcacaacagttggatggaaaggtctgatcaacgaccctgatattgacgagtcctaccagatcaacaagggtctccgcgtgtcccgcaagctctacgccgacctcacaggcatgggcatgcctattgccagcgagatgctcgacaccatctccccgcagtacatggctgacctgatttccctcggtgccattggtgcccgcaccaccgagtcgcaactgcaccgtgagcttgcctccggtctcagtttccccatcggttacaagaatggcactgacggcaacctgaccgttgccattgacgcgatcggcgctgctgcccacccccaccgcttccttggtgtcaccaagcaaggtcttgcggccattaccaagaccgccggtaaccctcacggcttcgtgattatgcgtggaggaaacaagggcacaaattacgaccgcgagagcatccagggggcccgcgaagcccttcgcggcaagaagcagcgtgaggttctcatggttgactgctcacatggcaactccaagaaaaaccaccgtaaccagcctctcgttgccaaggaggtcgctgaccaactccgtgagggccaggatgccatcattggtgtcatgattgaatccaacatcaacgagggtaaccagaaggttccccctgagggtccctccggtctcaagaagggtgtcagtatcaccgatgcctgcattgactgggagaccaccgtcactgtgttggaggacctcgccgatgccgtccgtgccaggcgcgccgtcaagtcaaaagccaacggtactgcttaa

SEQ ID NO: 1264 - protein, 362 aa, Aspergillus nidulans FGSC A4
MSGQNEDTRVLGYDPLLSPEFVQSEIPSNEHSIPTVRSGRNQAVEIIEQRDDRLLVVVGPCSIHDPETALEYATRLKELAARLSSDLCVIMRAYLEKPRTTVGWKGLINDPDIDESYQINKGLRVSRKLYADLTGMGMPIASEMLDTISPQYMADLISLGAIGARTTESQLHRELASGLSFPIGYKNGTDGNLTVAIDAIGAAAHPHRFLGVTKQGLAAITKTAGNPHGFVIMRGGNKGTNYDRESIQGAREALRGKKQREVLMVDCSHGNSKKNHRNQPLVAKEVADQLREGQDAIIGVMIESNINEGNQKVPPEGPSGLKKGVSITDACIDWETTVTVLEDLADAVRARRAVKSKANGTA

SEQ ID NO: 1265 - DNA, 1182 bp, Ustilago maydis 521
  CDS (1)..(1182)
atgtcggctagcattgctgccaacacggccaatggccgatccgccgagcccctcgctcaagcgcttcctcaaaatggctccaaggacgagtacgcctacatcaacgacgtccgcgtcgctggctttgaaccactgatctcgccttcgcttttgctccacgagattcccgttcccaaggagtcgcaggccaccatcgcacgtgctcgaggccagtcgagtgccatcatcaacggacaggacgaccgccttctcgtcgtcgtcggtccatgctccattcacgatgtcgatcaggccaaggaatacgcaaagctgctcaaggctggtatcgacgagcgatggtccgagggtcttgtggttgtcatgcgtgcctactttgaaaagcctcgcaccacagttggctggaaaggtctcatcaacgatcccgacatcaatggcagcttccagatcaaccgtggtctcaaaattgcccgtaacttgctcgtcgatcttacggcacaaggagtccccgtcgcttgcgaggtgcttgataccatctcgcctcagtacacttcggacctctactcgtggggtgccatcggtgctcgtaccaccgagtcgcaattgcaccgtgagttggtctcgggtctttccatgccaatcggcttcaagaatggcaccgatggcggtctcggtgttgctgtcgacgccatccgcgcttcgtctcagcctcacgctttcatgggcgttaccgagcagggtcttgcagctatcgtccgaaccgtaggcaacgctgatctccacatcgtccaccgtggtggctccaagggaaccaactacgacgctacctcggtccagacctcgaaagcacagctcaagtcggcgctccctaaccgccacccttcgatcatgattgactgctcgcacggtaactcgaacaaggacttccgcaaccagcccaaggtcgtcgatgccatcgtagagcagctcgaacagggcgaagatgccatcactggtgtcatgatcgagtcgcatctgaacgagggcaagcagggcgagcccaagaatggacagatcgatcagctcaaatacggtgtctcgatcaccgacggatgtgtcggatgggagaccaccgtgcagatgctcgacaagctcaacgccgccgtcctcaagagaagacaggtacaggctcagaacaaggcttga

SEQ ID NO: 1266 - protein, 393 aa, Ustilago maydis 521
MSASIAANTANGRSAEPLAQALPQNGSKDEYAYINDVRVAGFEPLISPSLLLHEIPVPKESQATIARARGQSSAIINGQDDRLLVVVGPCSIHDVDQAKEYAKLLKAGIDERWSEGLVVVMRAYFEKPRTTVGWKGLINDPDINGSFQINRGLKIARNLLVDLTAQGVPVACEVLDTISPQYTSDLYSWGAIGARTTESQLHRELVSGLSMPIGFKNGTDGGLGVAVDAIRASSQPHAFMGVTEQGLAAIVRTVGNADLHIVHRGGSKGTNYDATSVQTSKAQLKSALPNRHPSIMIDCSHGNSNKDFRNQPKVVDAIVEQLEQGEDAITGVMIESHLNEGKQGEPKNGQIDQLKYGVSITDGCVGWETTVQMLDKLNAAVLKRRQVQAQNKA

SEQ ID NO: 1267 - DNA, 1560 bp, Ustilago maydis 521
  CDS (1)..(1560)
atgctaatatcacgaaatgaaaatcgtctcgggctgattggtcccccattcgcacattatgactcgatgctgcagcaaagccaaggccaagaggatggcaaggtccagaccttagccgctggctgctggctaggcccaacctcttcacgctttgtttttctcacgtcgagaagaattcgtggttgcaattacaagtgcgtggtgatttgtcttgagcgcgcattgacctactcggccaagggcgacacttgtgccaccactcacgacttggttcttacctttcacttgggaccctcactgaaagcggatctaccgttcaaaatgacgacgctcacctacaaggatgcgctcaacgagctcgacgatcgacgcatcaagtcaatcaagccgctgattcctccgcagatcctggtcgaggaatatccactgtcgctctccgcagcgcagactgtcgcttctggtcgcaaggctaccgaggaaatcgttaagcaggaagacgatcgcttgctcgtcgtcgtgggcccgtgttcgattcacgatgtgcgttccggtctcgagtacgcgcgcaaactcgccgcttacgcccaaactgccaaggacgatctgcacattgtgatgcgtgtctactttgaaaaacctcgcaccacggtcggctggaaaggtctcatcaacgaccccaacctgaatggttcgttccagatcaacaaaggactgcgtctcgcgcgcggcttcttgctcgaggtcaacaacctcggcttgcctgctggaacagagttcctcgacaccatctcgccgcagtacaccgccgacctgatcagctggggagctatcggcgcacgaaccaccgaatcgcaggttcaccgcgaactcagctcgggtctttcgatgccgatcggcttcaagaacggaaccgacggttcgatcagtatcgccgtggatgctatcaaggcagcttcgtccgaacacgtcttcttgtccgtcaccaagcagggcatctcggcgattgtcgagaccaacggaaacgatgcctgtcacgtcatcctgcgcggagctaacacaggacccaactactcggccgaacacgttggcgcggtatcgtcgaaactcaacgcggccggtttgccagcgagaatcatgatcgactgctcgcacggtaacagcgagaagaagcacgagaaccagatcaacgtcgtcaagtcgatcgcatcccaactcgcagccggcgactcgcaagcttgcaacatctttggcgtcatgatcgaatccaacctggtggccggtaaacagtcgatccctgcgcagggacccacggcactcaagtacggtcagagcatcaccgacgcttgcgtcgactgggacaccaccgttctcgctttggatctcttgcgagaaggcgtccgcaaaagaagatcatcccaccacgctagcaactggttcaaggccaaattgagcaggtccagcagctccgaaggcgtcaacgaccactttctctccaagcagtccgaacaccacaccggcttcaacgacgatgcgctcaccacactgggcaaatccaaataa

SEQ ID NO: 1268 - protein, 519 aa, Ustilago maydis 521
MLISRNENRLGLIGPPFAHYDSMLQQSQGQEDGKVQTLAAGCWLGPTSSRFVFLTSRRIRGCNYKCVVICLERALTYSAKGDTCATTHDLVLTFHLGPSLKADLPFKMTTLTYKDALNELDDRRIKSIKPLIPPQILVEEYPLSLSAAQTVASGRKATEEIVKQEDDRLLVVVGPCSIHDVRSGLEYARKLAAYAQTAKDDLHIVMRVYFEKPRTTVGWKGLINDPNLNGSFQINKGLRLARGFLLEVNNLGLPAGTEFLDTISPQYTADLISWGAIGARTTESQVHRELSSGLSMPIGFKNGTDGSISIAVDAIKAASSEHVFLSVTKQGISAIVETNGNDACHVILRGANTGPNYSAEHVGAVSSKLNAAGLPARIMIDCSHGNSEKKHENQINVVKSIASQLAAGDSQACNIFGVMIESNLVAGKQSIPAQGPTALKYGQSITDACVDWDTTVLALDLLREGVRKRRSSHHASNWFKAKLSRSSSSEGVNDHFLSKQSEHHTGFNDDALTTLGKSK

SEQ ID NO: 1269 - DNA, 1092 bp, Parachlamydia sp. UWE25
  CDS (1)..(1092): transl_table=11
atggaacttctcccctcatataaagaattaaaaagccaatttccggcaagcgcatctcaagataatttcattgaagattgtcgagaaactgtaaaatctattttaaatggtactgataagcgattgttattgattgtagggccctgctcaatccatgattttcattctgctaaggaatttgcatttagattaaaatgcttagcagaatctctttcgtctcattttttcattttaatgcgtgtctattgtgaaaaagcgagaacagcaacgggctggaaaggatttttgtatgatccacttttagacggttccaatcaacttttactcggaatcaaaaagacaagagaattgttgctagagctttgcgatttgcgaatccctgccgcaaccgaatttttagatcctttaaccgcttattattatgaagatttaatttcttgggggtcgattggagcgagaacttcctcttcacaaatccacaggcaatttgcttcgaatttgcaaattccgataggctttaaaaatggaattgctggtaatatttcagctgctgttcaaggagcctatgcggcttctcaaccccatgcttacatggctttacacgaaaatggatggccaattgcaacgcaatctaaaggaaatctcgatactcacattgttttaagaggtggggaaacaaaaaccaattttgactctcattcgatatctgaagcgcttgcaaggttatcccatgcaaacttgccagaaagagtgttgatcgattgttctcatcataattcaaataaaaaacatgaaaaacaaccaattgtttttcaatccattatcgatcaagtactggcaggaaattcctttattaaaggtttaatgatagaaagtcacctttatgccggcaatcaaccttttcatttcaatccacaagagcttcgttatggtgtttcgattacggattcttgcttagattggaattcaactcaaacactcattgaatggggtgctcatcaattgcaagaaaatcttaatccgagtaagaagttatctttgtcttcagaatctctttttagttcgatgatatgtacaaagctaaaaagttaa

SEQ ID NO: 1270 - protein, 363 aa, Parachlamydia sp. UWE25
MELLPSYKELKSQFPASASQDNFIEDCRETVKSILNGTDKRLLLIVGPCSIHDFHSAKEFAFRLKCLAESLSSHFFILMRVYCEKARTATGWKGFLYDPLLDGSNQLLLGIKKTRELLLELCDLRIPAATEFLDPLTAYYYEDLISWGSIGARTSSSQIHRQFASNLQIPIGFKNGIAGNISAAVQGAYAASQPHAYMALHENGWPIATQSKGNLDTHIVLRGGETKTNFDSHSISEALARLSHANLPERVLIDCSHHNSNKKHEKQPIVFQSIIDQVLAGNSFIKGLMIESHLYAGNQPFHFNPQELRYGVSITDSCLDWNSTQTLIEWGAHQLQENLNPSKKLSLSSESLFSSMICTKLKS

SEQ ID NO: 1271 - DNA, 1056 bp, Acinetobacter sp. ADP1
  CDS (1)..(1056): transl_table=11
atgaacgcgcttaatacattgatccagaaaaatacgacaaaagaaattacacttagcttgccacagcaattaaaagcaaaatattcgcttgctcccatttttttagagcagatcgcagagcatcgtcaaaccattcaaaatatccttgctggcaaagattcacggcttttggtcgtaactggtccatgttcgattcatgatcctgtttctgcgctgcaatacgcacaaaggcttgtcaaattacaagatcaagttaaagatcagatttttttagtgatgcgtgcttatctcgaaaaaccacgtacaacaattggctggaagggttttttatacgatccaaatcttgatggttcatcagatttacagctgggtttagaaaaatctcgcgcattatatttgcaaattattgaaatggggcttccaattgccagtgaaattttaagcccaatggcgactggctattttgatgatttactggcttggggagctattggggcacgtaccagtgaatctcagattcatcgtgaaatttcaagtcatatgccgtttccaattggttttaaaaatggtactgatggttcgattcagatcgcattggatgccattcaatctgcacaaaatgaacatcagtttttagggatgagtcagcttggccagcctgcaattttacaaagttctgggaatccactgccgcatttgatcttgcgtggagcaaatgatggaccaaattatgatattcagtccatttcgaatattagagcaaaacataagggcgaattacctgcgcttgtaattgactgtagtcatggcaatagttcaaaagatccgatgaaacaaccgcaagtacttcgacaaatcattgcagaaagaattgaaagtgatgttcgaggtgtgatgttggaaagccatttggtcgatggaaatcagaagatttcatgcgacataacctatggccaatctgtgactgatggttgccttgggtgggagaagacagagaatttacttttagaaatggctgatcaactcgcacaatgtcctttacgccaatcagcttaa

SEQ ID NO: 1272 - protein, 351 aa, Acinetobacter sp. ADP1
MNALNTLIQKNTTKEITLSLPQQLKAKYSLAPIFLEQIAEHRQTIQNILAGKDSRLLVVTGPCSIHDPVSALQYAQRLVKLQDQVKDQIFLVMRAYLEKPRTTIGWKGFLYDPNLDGSSDLQLGLEKSRALYLQIIEMGLPIASEILSPMATGYFDDLLAWGAIGARTSESQIHREISSHMPFPIGFKNGTDGSIQIALDAIQSAQNEHQFLGMSQLGQPAILQSSGNPLPHLILRGANDGPNYDIQSISNIRAKHKGELPALVIDCSHGNSSKDPMKQPQVLRQIIAERIESDVRGVMLESHLVDGNQKISCDITYGQSVTDGCLGWEKTENLLLEMADQLAQCPLRQSA

SEQ ID NO: 1273 - DNA, 1113 bp, Acinetobacter sp. ADP1
  CDS (1)..(1113): transl_table=11
atgatccaatcagtgacagcaatgaatactttacagtccaatccagtttcacagccagatatcgatgatgttaacatcaaaagcatccagcctcttgttacgcctgccgagttaaaagcagagcttccactgacagaaagtgcttatcaaaccgtactccacggtcgtgaaaccattcgcaacattcttgatggtacagacaaacgtatttttgttgtcattgggccatgctctattcacgaccctaaagcagcgcatgaatacgcaacacgcttaaaagtactcagcgaaaaagtaaaagacagtttgtatattgtgatgcgtgtttattttgaaaaaccacgtacaacagtaggctggaaaggtttgattaatgatcctgatatgaatgactcattcaatattgaaaaaggtctgcgtattggacgtaaattactccttgaactaaacgaacaaggtctaccttgtgctacagaagcgcttgatccaaactctcctcagtattatcaagatctgatttcatggtcggctattggcgctcgtaccactgaaagtcagacacatcgtgagatgtcatctggattatcatcaccagttggctttaaaaacggaacagatggtgggcttacagtcgcaacaaatgcgatgcaatctgtcaaacacggtcacagctttttaggtttgaatgaagctggtcaggtttctgtcattcataccagtgggaatccatatgcacacgttgtattacgtggcggtaacggaaagccaaactatgatgcagggtcagtcgcagaagctgaaaatgcactggcaaaagcaaaagtcagcactaaaatcatgattgatgccagccatgccaattcaaataaagacccatacttacagccacttgtactcaaaaatgtaaccgagcaaatcatcgacggtaataagtcaatagtgggtgtcatggttgaaagtcacctcaaaggcggacgtcaggatattcctgaaaacctatgtgatcttgaatacggcaagtctgttaccgatggctgtattgattgggaaaccacagaaaatgttttgcttgaaatgcatgaagcactcaaagatgttttagctcagcgttaa

SEQ ID NO: 1274 - protein, 370 aa, Acinetobacter sp. ADP1
MIQSVTAMNTLQSNPVSQPDIDDVNIKSIQPLVTPAELKAELPLTESAYQTVLHGRETIRNILDGTDKRIFVVIGPCSIHDPKAAHEYATRLKVLSEKVKDSLYIVMRVYFEKPRTTVGWKGLINDPDMNDSFNIEKGLRIGRKLLLELNEQGLPCATEALDPNSPQYYQDLISWSAIGARTTESQTHREMSSGLSSPVGFKNGTDGGLTVATNAMQSVKHGHSFLGLNEAGQVSVIHTSGNPYAHVVLRGGNGKPNYDAGSVAEAENALAKAKVSTKIMIDASHANSNKDPYLQPLVLKNVTEQIIDGNKSIVGVMVESHLKGGRQDIPENLCDLEYGKSVTDGCIDWETTENVLLEMHEALKDVLAQR

SEQ ID NO: 1275 - DNA, 1056 bp, Erwinia carotovora subsp. atroseptica SCRI1043
  CDS (1)..(1056): transl_table=11
atgaattaccaaaatgatgatttaagaattaaagagattaatgaacttttgccgccggttgctttgctagaaaagtttccagccacggagaaggccgcggaaacggtatcgttcgcgcgtacagccatccataaaattcttaacggcaatgatgaccgcctgctggtggtgattggtccttgctcgatccacgacacgaaagccgcgaaagagtatgccgcacgtctgctgacgctgcgtagcgagctgagcgacgatctggaagtggtcatgcgggtttattttgaaaaaccacgcaccacgattggctggaaagggctaatcaacgatccgcacatggataatagtttccagatcaacgatggtctacgcattgcgcgccagctgctgctggaaattaacgataccggtttacctgctgcgggtgaattcctggatatgattactccgcaatacctggcggatctgatgagctggggcgctattggcgcacgtactacagaatctcaggtacaccgtgaattagcgtctggcctgtcatgtcctgtgggctttaaaaacggcactgacggcacgatcaaagtagcgattgatgcgatcaacgcagccagtgcgccgcactgcttcctgtctgtcaccaaatggggacattcggctatcgtgaataccagtggtaacaacgattgccacatcattctgcgtggtggtaaaacgccgaactatagcgctgagcacgttaaagacgtgaaaattggcttggaaaaagcgggcctgacaccgcaggtcatgatcgatttcagccatgcgaacagcagcaagcagttcaaaaagcagatggaagtctgtactgatgtctgtgggcagatcgcacagggtgaaaaagcgattatgggcgtgatggtggaaagccatctggttgaaggcaaccagaatctggaaagcggcgaacctctggtttatggccgtagcgttaccgatgcctgtattagctgggaagacacagaatcactgttgcgccagttagcgtctgctgtacgagagcgccgcaataagtaa

SEQ ID NO: 1276 - protein, 351 aa, Erwinia carotovora subsp. atroseptica SCRI1043
MNYQNDDLRIKEINELLPPVALLEKFPATEKAAETVSFARTAIHKILNGNDDRLLVVIGPCSIHDTKAAKEYAARLLTLRSELSDDLEVVMRVYFEKPRTTIGWKGLINDPHMDNSFQINDGLRIARQLLLEINDTGLPAAGEFLDMITPQYLADLMSWGAIGARTTESQVHRELASGLSCPVGFKNGTDGTIKVAIDAINAASAPHCFLSVTKWGHSAIVNTSGNNDCHIILRGGKTPNYSAEHVKDVKIGLEKAGLTPQVMIDFSHANSSKQFKKQMEVCTDVCGQIAQGEKAIMGVMVESHLVEGNQNLESGEPLVYGRSVTDACISWEDTESLLRQLASAVRERRNK

SEQ ID NO: 1277 - DNA, 1047 bp, Erwinia carotovora subsp. atroseptica SCRI1043
  CDS (1)..(1047): transl_table=11
atgctacaaacagatgaactgcggagcgcgcgcatcgagagtctggttacgccccaaacgctacttgccagactcccgattacccctgacgttgccgaaaatgtcacctcctcacgcaagaaaattgaagccattctcaccggccacgatccccgtttactcgttgtgattggcccctgttcgatccatcacaccgacagcgccttggactatgcgcgccgtctggctgtgctacgcacgcagtatcaggatcggctggaaattgtcatgcgcacttattttgaaaaaccgcgcacggtggtcggttggaaggggcttatctccgatcccgcactcaatggctcgttccaggtgaacgaagggctggagattgctcgccgtctgctgctggacgtcaatcaacttggattgccgaccgcaacggaattcctcgatatggtcaccggccaatatatcgccgatttgattagctggggcgcgattggtgcgagaaccaccgaaagccaaatccaccgcgagatggcgtctgcactatcctgccctgtcggcttcaaaaacgggacggatggcaatacacgcatcgccgtcgatgcgatccgtgccgcacgcgcccaacacatgttcctctcgccggacaaacaaggcttcatgtcggtttacaaaacgcagggcaacccgtttggccacataattatgcgcggcgggaaaaaaccgaactatcacgcggaagatattgccgctgcctgcgcgcatctcagcgagttttctctgcccgaacatctggtgatcgatttcagccatgctaactgtcagaaacagcatcgccgccagctcgatgttgccgatgatatctgccagcaaattcgcgctggttcacgcgccatcgcaggcatcatggcggaaagtttcttaatcgaagggagtcagccggcgatcaacccgctggcgctgacgtatgggcaatccattaccgatccttgcctaagctggcaggacaccgaaacgctgctggcacgtctggcaagcgctgtcgatagccgattctag

SEQ ID NO: 1278 - protein, 348 aa, Erwinia carotovora subsp. atroseptica SCRI1043
MLQTDELRSARIESLVTPQTLLARLPITPDVAENVTSSRKKIEAILTGHDPRLLVVIGPCSIHHTDSALDYARRLAVLRTQYQDRLEIVMRTYFEKPRTVVGWKGLISDPALNGSFQVNEGLEIARRLLLDVNQLGLPTATEFLDMVTGQYIADLISWGAIGARTTESQIHREMASALSCPVGFKNGTDGNTRIAVDAIRAARAQHMFLSPDKQGFMSVYKTQGNPFGHIIMRGGKKPNYHAEDIAAACAHLSEFSLPEHLVIDFSHANCQKQHRRQLDVADDICQQIRAGSRAIAGIMAESFLIEGSQPAINPLALTYGQSITDPCLSWQDTETLLARLASAVDSRF

SEQ ID NO: 1279 - DNA, 1074 bp, Erwinia carotovora subsp. atroseptica SCRI1043
  CDS (1)..(1074): transl_table=11
atgcaaaaagattcgcttaataatattaatatcagtgcagaacaggttttgattactcccgatgaattgaaagccaagtttccgcttaacgacgtggagcaacgcgacattgcgcaagcgagagcgaccattgcggacatcattcatggccgtgatgaccggttattgatcgtctgcggaccttgctctattcatgatacagatgcagcgctggaatatgcgcgccgcttgcagttgcttgccgctgaattgaacgatcgtctctacattgtgatgcgcgtttattttgaaaagccacgtacaacagtgggttggaaagggctcatcaacgatccattcatggatggttcatttgatgtggaatctgggttgcacatcgctcgtgggctgcttctgcaactggtgaatatggggctgccgctggcgacagaagcgcttgatccgaacagtccgcagtacctgggcgatctatttagctggtcagctatcggcgcacgtacgactgaatcacaaacgcaccgtgagatggcttctggcctgtcgatgcctgttgggttcaaaaacggaacggatggcagtctgggaacggcgatcaatgcgatgagagctgccgcgatgccacatcgcttcgtcggtatcaatcaaactgggcaagtttgtctgctgcaaacgcaggggaatggtgatggccatgtgattctgcgcggtggtaaaaccccaaactacagtgcacaggatgtcgccgaatgtgaaaaacagatgcaggaagcaggactgagacctgcgctgatgatagattgtagccacggtaattcgaataaagactaccgccgtcagccactggttgttgaatctgcgattgaacaaatcaaggcgggaaatcgttcgattataggactgatgctggaaagccaccttaacgaggggagccagtcttcagaacaaccacgttcagatatgcgctacggtgtatcagtcacggatgcttgtatcagttgggaaagtacagaaacgttgctgcgttccgttcatcaagatctgagtgccgcacgtgtgaaacattcaggagagtaa

SEQ ID NO: 1280 - protein, 357 aa, Erwinia carotovora subsp. atroseptica SCRI1043
MQKDSLNNINISAEQVLITPDELKAKFPLNDVEQRDIAQARATIADIIHGRDDRLLIVCGPCSIHDTDAALEYARRLQLLAAELNDRLYIVMRVYFEKPRTTVGWKGLINDPFMDGSFDVESGLHIARGLLLQLVNMGLPLATEALDPNSPQYLGDLFSWSAIGARTTESQTHREMASGLSMPVGFKNGTDGSLGTAINAMRAAAMPHRFVGINQTGQVCLLQTQGNGDGHVILRGGKTPNYSAQDVAECEKQMQEAGLRPALMIDCSHGNSNKDYRRQPLVVESAIEQIKAGNRSIIGLMLESHLNEGSQSSEQPRSDMRYGVSVTDACISWESTETLLRSVHQDLSAARVKHSGE

SEQ ID NO: 1281 - DNA, 1047 bp, Yersinia pseudotuberculosis IP 32953
  CDS (1)..(1047): transl_table=11
atgtacaagacagatgaactgcggaccgctcgcatcgatagcttgattacaccgcagcaactggctgaaaagttaccgatttctgaggttattgcagataacgtgacagcgtcacgtaaacgaatagagaaaatacttattggtgaagacccacgtctactcgtggtgattggcccctgctctattcacgaccttgatgcagccgttgattatgccacccggctcaaggtgctacgagaacgctatcaagaccggctggaaatcgtgatgcgcacctatttcgagaaaccacggactgtagtgggttggaaggggctgatttctgatccggcacttgacggctcatgccaggtgaacttgggtattgaactggcacgtaagctactgttagccgtgaatgaactcgggctgccgaccgctaccgagttcctcgatatggtaacaggccaatatattgccgacctcatcagttggggggcaataggcgcacgtaccaccgaaagccagatccaccgagagatggcctcggcactctcctgccccgtgggtttcaaaaatggtacagatggcaatgtgcgtattgctattgatgccattcgcgccgcacaagccagccatatgttcctttctccggataaaaccggccaaatgacgatttaccaaaccagtggtaacccctatgggcatattattatgcggggtggcaagcaacctaactatgatgcctctgatatcgcagccgcctgtgacagcttgcgggaatttgatttgccagaacatctggtggtggattttagccacggcaattgccagaagatgcatcgccgccagttggatgttgccgaaaatatcgggctacagatccgcgcgggttcaacagcgattgtcggtgttatggctgagagtttcctgattgagggcacacagaagattgttgccggacagcccttaacttatgggcaatccatcactgacccttgcctgaattgggatgatactgaacaactgttaagcctattggcagatgcagtaaacagccggttttaa

SEQ ID NO: 1282 - protein, 348 aa, Yersinia pseudotuberculosis IP 32953
MYKTDELRTARIDSLITPQQLAEKLPISEVIADNVTASRKRIEKILIGEDPRLLVVIGPCSIHDLDAAVDYATRLKVLRERYQDRLEIVMRTYFEKPRTVVGWKGLISDPALDGSCQVNLGIELARKLLLAVNELGLPTATEFLDMVTGQYIADLISWGAIGARTTESQIHREMASALSCPVGFKNGTDGNVRIAIDAIRAAQASHMFLSPDKTGQMTIYQTSGNPYGHIIMRGGKQPNYDASDIAAACDSLREFDLPEHLVVDFSHGNCQKMHRRQLDVAENIGLQIRAGSTAIVGVMAESFLIEGTQKIVAGQPLTYGQSITDPCLNWDDTEQLLSLLADAVNSRF

SEQ ID NO: 1283 - DNA, 1056 bp, Mannheimia succiniciproducens MBEL55E
  CDS (1)..(1056): transl_table=11
atgaaagatagtatccataatgttcatatcattgatgaaaaagtattaattacacctgccgaattaaaacaaaagctcccgctcccaatcgcactgcgtacacaaattgaaacacatcgccgtgaaattgccgatatagtacacaaaaaagacgatcgcttactggtggtcattgggccttgttccgtacatgacaccaaagcggcaatcgattatgccaaacgtctgaaagcgctttcagatgaattaaaggatcagctttatatcgttatgcgggtttattttgaaaaaccgcgtaccacggtaggctggaaagggctcattaatgacccgcgtatcgacggcacatttaatgtggaagaagggctgcatatcggtcgtaaattattgctggatttagctgaaatgggcttgccgttggcaacggaagcgttggatccgatgacgccgcaatatctcgccgatttattcagttggtcggctatcggcgcgcgtactaccgaatcgcaaactcaccgtgaactggcttccggattatctatggcagtcggctttaaaaacggcaccgacggtagtctggctaccgccattaatgccatgaaagccgcctcaatgggacacagttttatcggtattaaccagcaaggacaggtcaatttattacatacggagggcaatcctgacggtcatgttatcctgcgtggcggcaaaaaaccgaattaccaacaggaatttgtcaaccaatgcgaagaagaattagccaaagcaggtctggaaacggcgattatgatcgattgcagccacggtaattcaaataaagattataaacgccagccttcagttgcgaaagatgcggtaaatcaaattgtggcggggaataaatccattatcggtttaatgattgaaagcaacatcaatgcgggtaaccaaagctcggaacaaaaggtttccgagatgaaatacggtgtttccattaccgatgcctgtattgattgggaaacaacggataatttattacgtaaaattgccgccgcattgaaaaatagagcggagtaa

SEQ ID NO: 1284 - protein, 351 aa, Mannheimia succiniciproducens MBEL55E
MKDSIHNVHIIDEKVLITPAELKQKLPLPIALRTQIETHRREIADIVHKKDDRLLVVIGPCSVHDTKAAIDYAKRLKALSDELKDQLYIVMRVYFEKPRTTVGWKGLINDPRIDGTFNVEEGLHIGRKLLLDLAEMGLPLATEALDPMTPQYLADLFSWSAIGARTTESQTHRELASGLSMAVGFKNGTDGSLATAINAMKAASMGHSFIGINQQGQVNLLHTEGNPDGHVILRGGKKPNYQQEFVNQCEEELAKAGLETAIMIDCSHGNSNKDYKRQPSVAKDAVNQIVAGNKSIIGLMIESNINAGNQSSEQKVSEMKYGVSITDACIDWETTDNLLRKIAAALKNRAE

SEQ ID NO: 1285 - DNA, 1155 bp, Mannheimia succiniciproducens MBEL55E
  CDS (1)..(1155): transl_table=11
ttgataagctttaaagtgcggttaaatttttctatttttcggatgatatacagagagttgattatgcctacaaaaaacaaaaataatattcgtgtcgcaaacgacgataccagaattgccaatatcgaacagttgcttccgccggtcgctttattggaaaaatatccggcaagcaatgtcgccgttaaaacggtcagaaacgcccgcaataaagcccatcaaattattcacggtgaagatgatcgcctgttggtgattatcggtccttgttcgattcatgatcctaaagcggcgcttgaatatgccaaccgcatggcgaaaatgcgcgaaaaatataaagataccttagaaatcatcatgcgcgtttattttgaaaaaccgcgtactaccgtgggttggaaagggttaattaacgatccgtatttaaacgatacctatgcattaaacgacggtttacgtattgcgcgcaaactattatcagacatcaatgatctcggtttgccgactgcgggtgaatttttagacatgatcaccccgcaatatgtggctgatttcatgagctggggcgcaattggcgcccgtaccacggaatcgcaggttcatcgtgaactggcttccggtttgtcttgtgcggtgggctttaaaaacggcacaaacggcggtgtgaaaatcgctttagacgctattggtgcggcggaagcttcccaccatttcttatcggttactaaattcgggcattcggcgattgtttcaacaaaaggtaatctggattgccatattattttacgcggcggtgataaaggtacgaattatgatgcggaaaatatcgcaaaagtttgtgctaatatcgagaaaagcggccgtatcggtcatgtaatgatcgacttcagccatgctaacagcagtaaacagttcaaaaaacaagtggaagtttgtcatgatgtcgcaaaacaaatcgcacagggttcaaaccaaattttcggcgtgatggttgaaagccacttggttgaaggtcgtcaggatttagtaaacggaaaagcggaaacttacggtcaaagtatcaccgatgcctgtatcggctgggatgacacggaaatcgtgttacaagaactgtccgatgcggtagccgctcgtcgcaaagtcaacggcaaataa

SEQ ID NO: 1286 - protein, 384 aa, Mannheimia succiniciproducens MBEL55E
MISFKVRLNFSIFRMIYRELIMPTKNKNNIRVANDDTRIANIEQLLPPVALLEKYPASNVAVKTVRNARNKAHQIIHGEDDRLLVIIGPCSIHDPKAALEYANRMAKMREKYKDTLEIIMRVYFEKPRTTVGWKGLINDPYLNDTYALNDGLRIARKLLSDINDLGLPTAGEFLDMITPQYVADFMSWGAIGARTTESQVHRELASGLSCAVGFKNGTNGGVKIALDAIGAAEASHHFLSVTKFGHSAIVSTKGNLDCHIILRGGDKGTNYDAENIAKVCANIEKSGRIGHVMIDFSHANSSKQFKKQVEVCHDVAKQIAQGSNQIFGVMVESHLVEGRQDLVNGKAETYGQSITDACIGWDDTEIVLQELSDAVAARRKVNGK

SEQ ID NO: 1287 - DNA, 1044 bp, Legionella pneumophila subsp. pneumophila str. Philadelphia 1
  CDS (1)..(1044): transl_table=11
atgagttattccatcttaaaaaaactgccaccaatagaaaaaattatccgggaattgccactatcccaccccgcctatctacaaattgcccaagaccgacaagaggtcaaagctattttggaagggcgagataaacgtcttttgatgatagttggtccttgttcagcatggcctaaaaaagcggtattggaatacgctgagcgtttggtacaactcaacagcaaagtaaaacacgctttaaaattaatcatgcgcgtttacattcaaaagccaagaaccaccaaaggctggactggaccggtgaatcaacccgatttattttcaactcctgatattgaggcaggtataaaatatacccgggacatgatgataaaagtcattcaaatggggctccctatcgctgatgaggctcttttcacccataatgccaaaggatttcttgaacttctgtcctgggttgcaataggcgcccgtagttcagaggatcaagagcatcgaatttttgcctccgcccttgactgtgccgtaggattaaaaaaccctacacatggttcactcgctgtcggagtaaacagcctggttgcatcacagcatcctcatgtcgctgtcttcgatggctatgaagtacaaacccatggtaatcatcatgctcatctcgttctgcgtggttcaaaccaagctcccaattactctgtttctcatctggaggaagtcatgtactacatgggcatgcatcagatagtgaacccttctgtcattattgatgttagccatgacaactgtctggtgaatgggaaaaaaaatcatcagctacaaccagagattgcatttaatattctggaaagcatcaaaaacagacctgatttaaaacaactggtcaagggattcatggtagaaagtttcatcaaagaaggtaatcaaaaattagattctatcaatcccgataacattgatttaagcgggttatccgttaccgatccttgcctcagttgggagaagacagaatcgttcctgttggaactggcagagagggaagcgttatga

SEQ ID NO: 1288 - protein, 347 aa, Legionella pneumophila subsp. pneumophila str. Philadelphia 1
MSYSILKKLPPIEKIIRELPLSHPAYLQIAQDRQEVKAILEGRDKRLLMIVGPCSAWPKKAVLEYAERLVQLNSKVKHALKLIMRVYIQKPRTTKGWTGPVNQPDLFSTPDIEAGIKYTRDMMIKVIQMGLPIADEALFTHNAKGFLELLSWVAIGARSSEDQEHRIFASALDCAVGLKNPTHGSLAVGVNSLVASQHPHVAVFDGYEVQTHGNHHAHLVLRGSNQAPNYSVSHLEEVMYYMGMHQIVNPSVIIDVSHDNCLVNGKKNHQLQPEIAFNILESIKNRPDLKQLVKGFMVESFIKEGNQKLDSINPDNIDLSGLSVTDPCLSWEKTESFLLELAEREAL

SEQ ID NO: 1289 - DNA, 1074 bp, Burkholderia mallei ATCC 23344
  CDS (1)..(1074): transl_table=11
atgcccccgcacaataccgacgacgtccgcatccgtgaactgaaggagctgactccgcccgcccacctgatccgcgaattcgcgctcggcgaggcggtgtcggagctcatctacaacgcgcgccaggcgatgcaccggatcctgcacgggatggacgatcgcctgatcgtcatcatcgggccgtgctcgatccacgacacgaaggcggcgctcgaatacgcgggccggctcgtccaggagcgcgagcgcttcgcaagcgaactcgagatcgtaatgcgcgtgtacttcgagaagccgcgcacgacggtcggctggaaggggctcatcaacgatccgcacctggataacagcttcaagatcaacgacggcctgcgcaccgcgcgcgagctgctgctgcagatcaacgagatggggctgcccgccggcaccgaatacctcgacatgatcagcccgcaatacatcgcggacctgatctcgtggggcgcgatcggcgcgcgcacgaccgaatcgcaggtgcaccgcgagctcgcgtcggggctgtcgtgcccggtcggcttcaagaacggcaccgacggcaacgtgaagatcgcggtcgacgcgatcaaggccgcatcgcagccgcaccatttcctgtcggtgacgaagggcgaccattcggcgatcgtgtcgacggccggcaacgaggactgccacgtgatcctgcgcggcggcaaggcgccgaactacgatgccgacagcgtgaacgccgcgtgcgcggacatcggcaaggccggcctcgccgcgcgcctgatgatcgacgcgagccatgcgaacagctcgaagaagcacgagaaccagattccggtatgcgcggacatcggccgccagatcgccgcgggcgacgagcgcatcgtcggcgtgatggtcgagtcgcacctcgtcgaaggccgccaggacctgaaggaaggctgcccgctcacgtacggccagagcatcaccgatgcatgcatcaactgggacgacagcgtgaaggtgctcgaagggctcgccgaagcggtgaaggcgcggcgcgtcgcgcgcggcagcggcaactga

SEQ ID NO: 1290 - protein, 357 aa, Burkholderia mallei ATCC 23344
MPPHNTDDVRIRELKELTPPAHLIREFALGEAVSELIYNARQAMHRILHGMDDRLIVIIGPCSIHDTKAALEYAGRLVQERERFASELEIVMRVYFEKPRTTVGWKGLINDPHLDNSFKINDGLRTARELLLQINEMGLPAGTEYLDMISPQYIADLISWGAIGARTTESQVHRELASGLSCPVGFKNGTDGNVKIAVDAIKAASQPHHFLSVTKGDHSAIVSTAGNEDCHVILRGGKAPNYDADSVNAACADIGKAGLAARLMIDASHANSSKKHENQIPVCADIGRQIAAGDERIVGVMVESHLVEGRQDLKEGCPLTYGQSITDACINWDDSVKVLEGLAEAVKARRVARGSGN

SEQ ID NO: 1291 - DNA, 1119 bp, Burkholderia mallei ATCC 23344
  CDS (1)..(1119): transl_table=11
atgcaaaacatcgacaatccgcaacgcgatcgggaaaccggcttcgccgacgcgacgcaggacacgacgcgcatcgacgacgtgcgcatcggcgcggtgcgcccgctcatctcgcccgcgctgctgcaggacgaactgccggtgccgagcgccgtccaggcgctcgtcgaagcgagccgcgacgcgatcggcgacgtgctgcacggccgcgacgaccgcctgctcgcgatcgtcggcccgtgctcgatccacgatcacgatcaggcgctcgactacgcgcgccggctgaaaagcgccgccgacgcgctgcgcgacgacctgctgatcgtgatgcgcgtgtatttcgagaagccgcgcacgacggtcggctggaagggctacatcaacgatccgcgcctcgacggcagcttccgcatcaacgaagggctgcgcgccgcgcgccggctgctgatcgacatcaacgcgctcggcctgcccgccggcaccgaattcctcgatctgctgagcccgcagtacatcgcggatctgatcgcctggggcgcgatcggcgcgcgcacgaccgagagccagagccaccggcagctcgcgtcggggctgagctgcccgatcggcttcaagaacggcaccgacggcggcgtgcaggtcgcggccgacgcgatcgtcgcggcgcgcgcgagccacgcgttcatgggcatgacgaagatggggatggccgcgattttcgagacgcgcggcaacgacgccgcgcacgtgatcctgcgcggcggcaagcggggcccgaactacgatcgcgcgagcgtcgacgaggcgtgcgcggtgctgcgcgcggcgggccagcgcgagcaggtgatgatcgactgctcgcacgcgaattcgaacaagtcgcacctgcggcaggtcgacgtcgccgaggacctcgcgcgccagttgtcggacggcgagcgacgcatcaccggcgtgatggtcgagagcaacctggaggccggccggcaggacctgaagcccggcgtgccgctgcaatacggcgtgtcgatcaccgacgcgtgcctgagctgggcgcagaccgagcccgtgctcgacacgctcgcgcaggcggtgcggcggcggcgcgccgcctga

SEQ ID NO: 1292 - protein, 372 aa, Burkholderia mallei ATCC 23344
MQNIDNPQRDRETGFADATQDTTRIDDVRIGAVRPLISPALLQDELPVPSAVQALVEASRDAIGDVLHGRDDRLLAIVGPCSIHDHDQALDYARRLKSAADALRDDLLIVMRVYFEKPRTTVGWKGYINDPRLDGSFRINEGLRAARRLLIDINALGLPAGTEFLDLLSPQYIADLIAWGAIGARTTESQSHRQLASGLSCPIGFKNGTDGGVQVAADAIVAARASHAFMGMTKMGMAAIFETRGNDAAHVILRGGKRGPNYDRASVDEACAVLRAAGQREQVMIDCSHANSNKSHLRQVDVAEDLARQLSDGERRITGVMVESNLEAGRQDLKPGVPLQYGVSITDACLSWAQTEPVLDTLAQAVRRRRAA

SEQ ID NO: 1293 - DNA, 1074 bp, Burkholderia pseudomallei K96243
  CDS (1)..(1074): transl_table=11
atgcccccgcacaataccgacgacgtccgcatccgtgaactgaaggagctgactccgcccgcccacctgatccgcgaattcgcgctcggcgaggcggtgtcggagctcatctacaacgcgcgccaggcgatgcaccggatcctgcacgggatggacgatcgcctgatcgtcatcatcgggccgtgctcgatccacgacacgaaggcggcgctcgaatacgcgggccggctcgtccaggagcgcgagcgcttcgcaagcgagctcgagatcgtgatgcgcgtgtacttcgagaagccgcgcacgacggtcggctggaaggggctcatcaacgatccgcacctggataacagcttcaagatcaacgacggcctgcgcaccgcgcgcgagctgctgctgcagatcaacgagatggggctgcccgccggcaccgaatacctcgacatgatcagcccgcagtacatcgcggacctgatctcgtggggcgcgatcggcgcgcgcacgaccgaatcgcaggtgcaccgcgagctcgcgtcggggctgtcgtgcccggtcggcttcaagaacggcaccgacggcaacgtgaagatcgcggtcgacgcgatcaaggccgcatcgcagccgcaccatttcctgtcggtgacgaagggcggccattcggcgatcgtgtcgacggccggcaacgaggactgccacgtgatcctgcgcggcggcaaggcgccgaactacgatgccgacagcgtgaacgccgcgtgcgcggacatcggcaaggccggcctcgccgcgcgcctgatgatcgacgcgagccatgcgaacagctcgaagaagcacgagaaccagattccggtatgcgcggacatcggccgccagatcgccgcgggcgacgagcgcatcgtcggcgtgatggtcgagtcgcacctcgtcgaaggccgccaggacctgaaggaaggctgcccgctcacgtacggccagagcatcaccgatgcatgcatcaactgggacgacagcgtgaaggtgctcgaagggctcgccgaagcggtgaaggcgcggcgcgtcgcgcgcggcagcggcaactga

SEQ ID NO: 1294 - protein, 357 aa, Burkholderia pseudomallei K96243
MPPHNTDDVRIRELKELTPPAHLIREFALGEAVSELIYNARQAMHRILHGMDDRLIVIIGPCSIHDTKAALEYAGRLVQERERFASELEIVMRVYFEKPRTTVGWKGLINDPHLDNSFKINDGLRTARELLLQINEMGLPAGTEYLDMISPQYIADLISWGAIGARTTESQVHRELASGLSCPVGFKNGTDGNVKIAVDAIKAASQPHHFLSVTKGGHSAIVSTAGNEDCHVILRGGKAPNYDADSVNAACADIGKAGLAARLMIDASHANSSKKHENQIPVCADIGRQIAAGDERIVGVMVESHLVEGRQDLKEGCPLTYGQSITDACINWDDSVKVLEGLAEAVKARRVARGSGN

SEQ ID NO: 1295 - DNA, 1092 bp, Methylococcus capsulatus str. Bath
  CDS (1)..(1092): transl_table=11
atgcccagcgtgtacaacaccgacgatcttcgcatctgcgagatcaaggaagtcattccgcccgtccaggttcatgaggaattcccgatcacggaccgggccgcactcacgacactgaccgcccgccgagggattcacgcaatcctttccaaggaggacgaccgcctgctggtggtgatcgggccctgttcgatccatgaccccaaggccgcgctcgaatacggggagcggctgctgccactccgccagaaactggcgagacatctggaaatcgtgatgcgggtctatttcgagaagccgcgaacgaccgtcggctggaagggcctgatcaatgatcccgatctggacgagagtttcaacatcaacaaaggcttgcgcctcgcccgcaagctgttgctcgatctgaacgaactgggcatgcccgcggccaccgagtacctcgatctcatcaccccgcagtatgtctccgacctgatcgcttggggcgccatcggtgctcgtaccacggagagccagtctcaccgtgaactggcatcggggctgtcatgtccggttggattcaagaacgccaccgacggcacgatcaaggttgctgtcgacgccataggtgcggcacggcggccacatcatttcctgtctttgaccaaggccggtcattcggcgatcttctccacgaccggtaacgccgactgtcacatcatccttcgtggcggagcccggccgaattacgacgcggccagcgtcgaagcggcggccagggcgctggaagccgtcggcctgccgcccaacatcatggtggactgcagccatgccaacagcatgaaggattacctgaagcagctgcgggtggccgaggacgtggccgaacagatagacggcggcgacaggcggatcatcggcttgatggtggaaagtcacctcaagccgggcaatcagaaactccacaagggcatggttcccgaatacggcgtcagcatcaccgatgcctgcatcggctgggatgacagcgtggccgtgctggaacggctcgccgccgcggtggagagccggcgcggccggtcggcaggcatccggaacgtgcggggggcctga

SEQ ID NO: 1296 - protein, 363 aa, Methylococcus capsulatus str. Bath
MPSVYNTDDLRICEIKEVIPPVQVHEEFPITDRAALTTLTARRGIHAILSKEDDRLLVVIGPCSIHDPKAALEYGERLLPLRQKLARHLEIVMRVYFEKPRTTVGWKGLINDPDLDESFNINKGLRLARKLLLDLNELGMPAATEYLDLITPQYVSDLIAWGAIGARTTESQSHRELASGLSCPVGFKNATDGTIKVAVDAIGAARRPHHFLSLTKAGHSAIFSTTGNADCHIILRGGARPNYDAASVEAAARALEAVGLPPNIMVDCSHANSMKDYLKQLRVAEDVAEQIDGGDRRIIGLMVESHLKPGNQKLHKGMVPEYGVSITDACIGWDDSVAVLERLAAAVESRRGRSAGIRNVRGA

SEQ ID NO: 1297 - DNA, 1083 bp, Nocardia farcinica IFM 10152
  CDS (1)..(1083): transl_table=11
atgactaccgcagccgatgtcgacgcgcggcattccgatctcgacgaccagcgcaccctgtcggtgagcccgttgcgctcgcccgccgaggtgcgcatggtgcacccgatcaccgacgacctcgccgataccgtccgggcgggccgtaaggccaccgtcgaggtgctcgacggcaccgacgaccgcctgatggtgatcgtgggcccgtgctcggtgcacgaccccgccgccgccctcgactacgcccggcgcctggccgccaaggccgccgaactcgacgaccgcctgcacgtggtgatgcgggtgtacttcgagaagccgcgcaccagcctgggctggaagggcctggtcaacgatccgcacctggacggctccttcgacgtcaacaccggtctgggcatcggccgcaagttgctggtcgacatcaccgcgctcggcctgccggtcgcgtgcgagttcctcgatccgatcaccccgcagtacatcgccgatctggtgtcctacggcgcgatcggcgcgcgcaccgcggccagccaggtgcaccgccagctcagcagcgcgctgtccatgccggtcggcatcaagaacggcaccgacggtgacgtccaggtcgcggtcgacggtgtgcgggcggccgcggccagccacgtcttccccggtaccgatctcgacgggcgcgccgcgctgatccgcaccaccggcaacccggactgccacgtcatcctgcgcggcggcagcaacggcaccaactacgacgcggcctcggtggccgaggcgtgcctgcggctggagaaggccgggctggcgcgccgggtcgtcgtggacgccagccacggcaacagcaacaaggaccacaacaagcaggtcgacgtggtggccgacatcgccgagcggatcgcgggcggtgagcgcgaggtcgtcggcgtgatgctggagagcttcctggtggcgggccgccaggacctcaccctcggccggtcggcggatctggtctacggccagtcgatcaccgacgcctgcctggactgggagaccaccgccgcacagctcgaccgcctggccgaggccgtcgcggcgcgctag

SEQ ID NO: 1298 - protein, 360 aa, Nocardia farcinica IFM 10152
MTTAADVDARHSDLDDQRTLSVSPLRSPAEVRMVHPITDDLADTVRAGRKATVEVLDGTDDRLMVIVGPCSVHDPAAALDYARRLAAKAAELDDRLHVVMRVYFEKPRTSLGWKGLVNDPHLDGSFDVNTGLGIGRKLLVDITALGLPVACEFLDPITPQYIADLVSYGAIGARTAASQVHRQLSSALSMPVGIKNGTDGDVQVAVDGVRAAAASHVFPGTDLDGRAALIRTTGNPDCHVILRGGSNGTNYDAASVAEACLRLEKAGLARRVVVDASHGNSNKDHNKQVDVVADIAERIAGGEREVVGVMLESFLVAGRQDLTLGRSADLVYGQSITDACLDWETTAAQLDRLAEAVAAR

SEQ ID NO: 1299 - DNA, 1044 bp, Legionella pneumophila str. Paris
  CDS (1)..(1044): transl_table=11
atgagttattccatcttaaaaaagctgccaccaatagaaaaaatcatccgggaattgccactatcccaccccgcctatctacaaattgctcaagaccggcaagagatcaaagctattttggaagggcgagataaacgtcttttgatgatagttggtccttgctcagcatggcctaaaaaagcggtattggaatacgctgagcgtttggtacaactcaacagcaaagtaaaacacgctttaaaattaatcatgcgcgtttacattcaaaagccaagaaccaccaaaggctggactggaccggtgaatcaacccgatttattttcaactcctgatattgaggcaggtataaaatatacccgggacatgatgataaaagtcattcaaatggggctccctatcgctgatgaggctcttttcacccataatgccaaaggatttcttgaacttctgtcctgggttgcaataggcgcccgtagttcagaggatcaagagcatcgaatttttgcctccgcccttgactgtgccgtaggattaaaaaaccctacacatggttcactcgctgtcggagtaaatagcctggttgcatcacagcatcctcatgttgctgtcttcgatggctatgaagtgcaaacccatggtaatcatcatgctcatctcgttctgcgtggttcaaaccaagctcccaattactccgtttctcatctggaggaagtcatgtactacatgggcatgcatcagatagtgaacccttctgtcattattgatgttagccatgacaactgtctggtgaatgggaaaaaaaatcatcagctacaaccagagattgcatttaatattctggaaagcatcaaaaatagacctgatttaaaacaactggtcaaaggattcatggtagaaagtttcatcaaagaaggtaatcaaaaattagattctatcaatcccgataacattgatttaagcgggttatccgttaccgatccttgcctcagttgggagaagacagaatcgttcctgttggaactggcggagagggaagcattatga

SEQ ID NO: 1300 - protein, 347 aa, Legionella pneumophila str. Paris
MSYSILKKLPPIEKIIRELPLSHPAYLQIAQDRQEIKAILEGRDKRLLMIVGPCSAWPKKAVLEYAERLVQLNSKVKHALKLIMRVYIQKPRTTKGWTGPVNQPDLFSTPDIEAGIKYTRDMMIKVIQMGLPIADEALFTHNAKGFLELLSWVAIGARSSEDQEHRIFASALDCAVGLKNPTHGSLAVGVNSLVASQHPHVAVFDGYEVQTHGNHHAHLVLRGSNQAPNYSVSHLEEVMYYMGMHQIVNPSVIIDVSHDNCLVNGKKNHQLQPEIAFNILESIKNRPDLKQLVKGFMVESFIKEGNQKLDSINPDNIDLSGLSVTDPCLSWEKTESFLLELAEREAL

SEQ ID NO: 1301 - DNA, 1056 bp, Photobacterium profundum SS9
  CDS (1)..(1056): transl_table=11
atgccaatgaaaactgatgaactccgtaccgttagcctagggttaatgccaactccggcagaaattgaagctgtctctcctattactgacgaaattgcagcgcacgttgctgattctcgccgtcaagttgaagacatcctaaccggtaaggattctcgacttttagttgtcgtaggaccatgttctgttcacgatacagatgcagcaatggattatgctaaacaccttgttgctgttcaggaacaatacagagatgaactttgtattgttatgcgcacatactttgaaaagcctcgtaccgttgtaggctggaaagggttaatttcagatccacaccttgacggtagcttagattttgtcgcaggtttacataaagcacgtaagttattagtagatgtaaatgctttaggtttggctactgctactgaattccttgatatgattacaggacagtatcttgctgacttaatcacatggggagcaattggcgcgcgtacaactgagtctcaaattcaccgtgaaatggcttctgccctttcttgtcctgttggtttcaaaaatggtactgacggaaatatcaaaatagccattgatgcgattcgtgcaacacgtgaatctcacctattttgctcaccagcgaaaaatggtcaaatgacgatttaccgtacagcaggtaacccacacggtcatgtgattttacgtggtggcaaaatgccaaattaccaccaagctgatgttgaaacatcatgtaatacactggctgaatttgatttaccaacacgccttgttgttgacttcagccacggtaattgccaaaagcaacaccgtcgtcaacttgatgtcgcagctgatatctgtactcaaattcgtgaaggcagcaattacattgcgggtattatggctgaaagctttattattgaaggcaaccaagctgttgttgctggaaaagaaaaagaacttgtctacggtcaatctattacagacccttgtgtaaactgggaagataccgtcactatgctagatatgcttgctgacgcgatcaaaactcgtaaataa

SEQ ID NO: 1302 - protein, 351 aa, Photobacterium profundum SS9
MPMKTDELRTVSLGLMPTPAEIEAVSPITDEIAAHVADSRRQVEDILTGKDSRLLVVVGPCSVHDTDAAMDYAKHLVAVQEQYRDELCIVMRTYFEKPRTVVGWKGLISDPHLDGSLDFVAGLHKARKLLVDVNALGLATATEFLDMITGQYLADLITWGAIGARTTESQIHREMASALSCPVGFKNGTDGNIKIAIDAIRATRESHLFCSPAKNGQMTIYRTAGNPHGHVILRGGKMPNYHQADVETSCNTLAEFDLPTRLVVDFSHGNCQKQHRRQLDVAADICTQIREGSNYIAGIMAESFIIEGNQAVVAGKEKELVYGQSITDPCVNWEDTVTMLDMLADAIKTRK

SEQ ID NO: 1303 - DNA, 1113 bp, Photobacterium profundum SS9
  CDS (1)..(1113): transl_table=11
ttgccttctactacccagaatagattgaggaaagccaccatgcaaaaagaccaactgaataatgtacatattcaagatgaatgcgtattgatcactcctcaacaactaaaagccaggttgccactcagtgaaacagcactgaacttcattcgtgaatctcgtcaaaccattgcagatattactcacaagcgtgaccaccgtttactcgtggtatgcggaccatgctcaattcacgatattgacgcagcgaaagcgtacgcccaaaaattgaagcagctttctgaagagctaagtgatcaactgtacattgtaatgcgcgtttattttgaaaaaccacgtacaacagttggttggaaaggtcttatcaatgacccgcatcttgatggctcttttgaagtggaagaaggtttacacattggtcgtcagctactcattgacttggttgaaatggggattcctttagcaacagaagcgcttgatccgatcagtcctcaatacttaggtgatttattcagttgggcagccattggtgcacgtaccactgaatcacaaacacaccgtgaaatggcaagtggcctttcaatgcccgttgggtttaaaaatggtactgatggaagtttggcaacggctatcaatgccatgaaagctgcagcttctgggcaccgttttatggggattaatccagaaggtcaggtggcgctgttgaacacccaaggaaaccctgatggccatgtaattttacgtggcggtaagcaaacgaattatgattcagtctcggttactgagtgtgaaaatgagatgcatcagtcaggtctttcaccatccttgatggtagactgtagccatgcgaattcacgtaaagattaccgtcgtcagccattagtcgctgaagatgtacttcatcaaatccgtgaaggtaataaatcgatcattggtttgatgattgaaagccatttaaatgaaggtagtcaaagcgctgatttaccgcgcgaagaaatggcttatggggtatcgattaccgatgcatgtatcagctgggaagatacagaaacactattacgtcgtacgcgtaaagaattaacgcctttcttaaaggatcgctgcgaaggataa

SEQ ID NO: 1304 - protein, 370 aa, Photobacterium profundum SS9
MPSTTQNRLRKATMQKDQLNNVHIQDECVLITPQQLKARLPLSETALNFIRESRQTIADITHKRDHRLLVVCGPCSIHDIDAAKAYAQKLKQLSEELSDQLYIVMRVYFEKPRTTVGWKGLINDPHLDGSFEVEEGLHIGRQLLIDLVEMGIPLATEALDPISPQYLGDLFSWAAIGARTTESQTHREMASGLSMPVGFKNGTDGSLATAINAMKAAASGHRFMGINPEGQVALLNTQGNPDGHVILRGGKQTNYDSVSVTECENEMHQSGLSPSLMVDCSHANSRKDYRRQPLVAEDVLHQIREGNKSIIGLMIESHLNEGSQSADLPREEMAYGVSITDACISWEDTETLLRRTRKELTPFLKDRCEG

SEQ ID NO: 1305 - DNA, 1053 bp, Photobacterium profundum SS9
  CDS (1)..(1053): transl_table=11
atgcaaaaaacagatgacgtacgcattagcgagatcaaagaacttttaccaccagttgctgtattggaaagatttccagccactgaactggcggctgaaactgtatatcagtcacgtaaatcgattcacaacattctgaacgatgaagatgaccgtttgttggttgttgttgggccttgttcaattcatgacactgaagctgctatcgaatacggtaaaaagctgaaagtattacgtgaagaattaaaaggtgaccttgaaatcgtaatgcgtgtttactttgaaaaaccacgcaccacagtaggttggaaagggttaattaacgacccgtatatggacaatagctttaagttaaatgatggtttacgtattggacgtaagttgctacttgatttgaccgatatgggcttaccaacagcgggtgagttccttgatatgattaccccacaatacatgggtgatttgatcagctggggcgcaattggtgcgcgtactacagaatcgcaagttcaccgtgagctatcttcaggactatcttgccctgttggttttaaaaacggtacagatggcaacattaagatcgcgaccgatgcgattggatcggcaagtgcacctcaccactttttatcagtgactaagtatggtcattcagctattgtttctactttgggtaatgaagactgtcatatcattcttcgtggcggtaaagagcctaattacagctcagaacacgttaacgcggtgacatcacagctgggtaatgctggtcagcgtaagaaagtaatgattgattttagtcatgctaatagttcgaagaagtttgaacgtcagattattgtttctgaagatgtcggtcagcaagttgctggcggtaacaaagatatttttggtgttatggttgaaagccaccttgttgaaggtcgtcaagatatcgtagaaggcacagagccaacgtatggtcaaagtattaccgatgcatgtattggttgggcagatacagaaacagtacttcgtcaattagcacgtgatgttgctaagcgtcgtcaagcatag

SEQ ID NO: 1306 - protein, 350 aa, Photobacterium profundum SS9
MQKTDDVRISEIKELLPPVAVLERFPATELAAETVYQSRKSIHNILNDEDDRLLVVVGPCSIHDTEAAIEYGKKLKVLREELKGDLEIVMRVYFEKPRTTVGWKGLINDPYMDNSFKLNDGLRIGRKLLLDLTDMGLPTAGEFLDMITPQYMGDLISWGAIGARTTESQVHRELSSGLSCPVGFKNGTDGNIKIATDAIGSASAPHHFLSVTKYGHSAIVSTLGNEDCHIILRGGKEPNYSSEHVNAVTSQLGNAGQRKKVMIDFSHANSSKKFERQIIVSEDVGQQVAGGNKDIFGVMVESHLVEGRQDIVEGTEPTYGQSITDACIGWADTETVLRQLARDVAKRRQA

SEQ ID NO: 1307 - DNA, 1083 bp, Photobacterium profundum SS9
  CDS (1)..(1083): transl_table=11
atggctattcacccatcagtgatgagaacgacgacatgccgtcggcttccttcaccagcagaactgctcagtgactacccgtgcaaggccgacactgaacaccacattatgacatcgcgtaatgatgtgagggatattttacatggcaaagatgatcggcttttggtcgtgattggtccatgctcaattcatgacccggatgcagcactggcatacgcaaagcagcttaagccactggtcgaacagtttagtgatcacttacatattgtaatgcgaacgtatttcgaaaagccccgaacaacaactggttggaaaggcttaatattcgatccgcatctcgacaacagtaatgaccttattactgggttaacaacagcgcgtcagttagtgctcgctattaatgaacttggtgtaccaacctcaaccgaatttttggataataccagttttctatatttggccgacctcatgagctggggagccattggcgcccgcactacagagtcacaagttcaccgacagttaacctcgggcttaccctgccccgtcggtttcaaaaacggcaccgatggtaacattcgtattgcgacagatgccattctttcgagccaatcccctcacttgtataccgttacggggcacgatggacatttatatgcagtagaaagtacaggtaatgccgattgccacatcatcctacgtggtgggcaagaacctaactacagtccgggccatattcaagctgccagcaaagcgctataccaagccaagttaccagtaagtattatggtagattgcagccatggaaacagccaaaagcgtcataaaaaccaattagttgtcgcacaatcgttatgtgaacaactgtctcagggcgaacaagcaatcacgtcaattatggtggagagtttctttgaggaaggcagtcaagcgatcagtgccaatatgacctacggacaatcggtaacggatgcctgtatcaactggagcgacacagaaatattgcttaaccaatttgccgctgccattgcgactcgccgcgcactgtaccaatcggcctcgccagtcgccatgcacggctaa

SEQ ID NO: 1308 - protein, 360 aa, Photobacterium profundum SS9
MAIHPSVMRTTTCRRLPSPAELLSDYPCKADTEHHIMTSRNDVRDILHGKDDRLLVVIGPCSIHDPDAALAYAKQLKPLVEQFSDHLHIVMRTYFEKPRTTTGWKGLIFDPHLDNSNDLITGLTTARQLVLAINELGVPTSTEFLDNTSFLYLADLMSWGAIGARTTESQVHRQLTSGLPCPVGFKNGTDGNIRIATDAILSSQSPHLYTVTGHDGHLYAVESTGNADCHIILRGGQEPNYSPGHIQAASKALYQAKLPVSIMVDCSHGNSQKRHKNQLVVAQSLCEQLSQGEQAITSIMVESFFEEGSQAISANMTYGQSVTDACINWSDTEILLNQFAAAIATRRALYQSASPVAMHG

SEQ ID NO: 1309 - DNA, 1083 bp, Azoarcus sp. EbN1
  CDS (1)..(1083): transl_table=11
atgtccgcctcagtcaagattcacatcgatgatgtccgcatccaggagatcaaggaactgattccgcccgcccacgtgctgcgcgaatttccggcgacgccgaaggccgccgaagtggcgtacgaggcgaggcaggggatccaccgcatcctgttcggcgcggacgaccgcctgctggtcgtcatcggaccatgctcgatccacgatctggacgcggcgctcgaatacgcgcgcaagctcaaggccgaggcggtgcgccacaaggacgatctgctcgtcgtgatgcgggtgtatttcgagaaaccgcgcacgacggtcggctggaaaggcctgatcaacgatccctacctcgacaacagcttccgcatcaacgaaggcgtgcggctcgcgcgcaagctgctgtgggagatcagcgagatggggctggcggcgggcacggagttcctcgacatgatcacgccgcagtacatcgccgacctgatcgcgtggggcgcgatcggcgcccgcaccaccgaaagccaggtgcaccgcgaactcgcgtccgggctgtcgtgcccggtcggcttcaagaacggcaccgacggcaatgtcaggatcgccgtcgacgcgatcaaggctgcgcagtcgccgcatcatttcctctccgtcaccaaggcggggcattcggcgatcgtcacgacgctcggcaacgaggactgccacgtcatcctgcgcggcggcaagagcaccaactacgatgccgccagcgtcgatgcggcttgcaaggagctcgctgcttcgggcgtgccgggcaaggtgatgatcgatttctcgcatgccaacagccgcaagcaacatcgcctgcagatcgaggtcgcgcgcgatgtcggcgcgcagatggcgaacggcgacgaccgcctcatcggcgtgatggtcgagtcgcacctgaaggaaggccgccaggacctgatcccgggcaaggagctcgagtacggcaagagcatcaccgacgcgtgcctgggctgggaagacagcgtcaccgtgctcgaaatccttgccgaggcggtacgccagcggcgcgtcaaacgcgccgacctggagtga

SEQ ID NO: 1310 - protein, 360 aa, Azoarcus sp. EbN1
MSASVKIHIDDVRIQEIKELIPPAHVLREFPATPKAAEVAYEARQGIHRILFGADDRLLVVIGPCSIHDLDAALEYARKLKAEAVRHKDDLLVVMRVYFEKPRTTVGWKGLINDPYLDNSFRINEGVRLARKLLWEISEMGLAAGTEFLDMITPQYIADLIAWGAIGARTTESQVHRELASGLSCPVGFKNGTDGNVRIAVDAIKAAQSPHHFLSVTKAGHSAIVTTLGNEDCHVILRGGKSTNYDAASVDAACKELAASGVPGKVMIDFSHANSRKQHRLQIEVARDVGAQMANGDDRLIGVMVESHLKEGRQDLIPGKELEYGKSITDACLGWEDSVTVLEILAEAVRQRRVKRADLE

SEQ ID NO: 1311 - DNA, 1113 bp, Francisella tularensis subsp. tularensis SCHU S4
  CDS (1)..(1113): transl_table=11
atgataggtgataaaaactttgataaagtttctaatataaatataaaaaaggaaaaagtattgattcctgcagaagttctaatccaagatatacctcttttaaagacttcttttgaaactgtaagaaaatctcgtaaagaaatagctaatatcatccatggaaatgatgatagagttgctgtagttgtaggaccttgctctattcatgatcctgctgctgcaattgagtatgctactaaactcaaagagcaagttaagaaatttcataaagatatacttattataatgagggtatattttgaaaaaccacgtactacgattggttggaaaggatttatcaatgaccctgatttagataactcatataatatcaacaaaggtttacgtcttgcgcgtaatttattatcagatttaactaatatgggactaccgtgtgcaactgaatttctagatgtaattactccacaatactttgctgagctaatcacttggggagcaattggcgctagaactgttgaaagtcaggtacatagagaattagcttctggtctttctgcatcgattggttttaaaaatgccactaatggtgatgtccaagtagctgtagatgctgtaaaatctgccacttatccccatcacttcttaagtacgacaaaatctggttctacagcaatatttgcaactaaaggtaaccaaaatggtcatgtaattcttcgtggtggtgcctctggtcctaactttagtaaagagcatgttgatgactgtattgctaaactaaaaaaagctgatattaatactaaggtaatgattgactgtagtcacggcaatagtcaaaaagatcattctaagcaaattagcgtattagctgatatttgtgagcaaataaagcacagtaacgatatttttggggtaatgatagaaagtaatcttgtggctggtaatcaagatatcaataaaaaacctctcacttatgggcaaagtgtcacagataaatgcgttgactttgaagaaacagttaagatgctagaaatgttagctgaagcagtccaggtaagacgtggttctcaaactaaacaacaagttaaagaagagtcacaattttctttactgtaa

SEQ ID NO: 1312 - protein, 370 aa, Francisella tularensis subsp. tularensis SCHU S4
MIGDKNFDKVSNINIKKEKVLIPAEVLIQDIPLLKTSFETVRKSRKEIANIIHGNDDRVAVVVGPCSIHDPAAAIEYATKLKEQVKKFHKDILIIMRVYFEKPRTTIGWKGFINDPDLDNSYNINKGLRLARNLLSDLTNMGLPCATEFLDVITPQYFAELITWGAIGARTVESQVHRELASGLSASIGFKNATNGDVQVAVDAVKSATYPHHFLSTTKSGSTAIFATKGNQNGHVILRGGASGPNFSKEHVDDCIAKLKKADINTKVMIDCSHGNSQKDHSKQISVLADICEQIKHSNDIFGVMIESNLVAGNQDINKKPLTYGQSVTDKCVDFEETVKMLEMLAEAVQVRRGSQTKQQVKEESQFSLL

SEQ ID NO: 1313 - DNA, 1056 bp, Neisseria gonorrhoeae FA 1090
  CDS (1)..(1056): transl_table=11
atgacacaccattaccccacagacgatattaagattaaagaagttaaagagttgttgccgccgattgcccatctttacgagctgccgatttccaaagaggcttcgggcttggttcaccgcacccgtcaggaaatttccgatttggttcacggcagggacaggcggctgttggtcattatcgggccgtgttcgattcacgatccgaaagcggcgttggaatatgcggaacgtctgttgaaactccgcaagcggtatgaaaacgagcttttgatcgtgatgcgcgtttatttcgagaagccgagaacgacggtgggttggaaaggtttgattaacgacccgcatttggacggtacgttcgacatcaatttcggtttgcgtcaggcgcgcagtctgttgttgtccctgaataatatgggcatgcctgcctctaccgaatttttggatatgattacaccccagtattatgccgacctgatttcttggggggcaatcggcgcgcggacgaccgaaagccaagtccaccgcgaattggcaagcggtctgtcctgccccgtcggctttaaaaacggtacggacggcaatttgaagattgcgatcgacgcaatcggtgcggcgagccattcgcatcatttcttgtctgtaaccaaggccgggcattccgccattgtccataccggcggcaatcccgactgtcatgtcattttgcgcggcggaaaagagccgaattatgatgcgggacacgtcagcgaggcggtggaacaactgcgtgcggcaggggtaaccgacaagctgatgatcgattgcagccacgccaacagccgcaaggattacacccggcagatggaagtggcacaagacattgccgaccaattggaacaggacggcggcaatatcatgggcgtgatggtggaaagccatttggtcgaaggcaggcaggacaagccggaagtgtacggcaagagcattaccgatgcgtgtatcggttggggcgcgactgaagaattgttggcattgttggcgggtgcgaacacaaaacgtatggcgcgcgcaggttga

SEQ ID NO: 1314 - protein, 351 aa, Neisseria gonorrhoeae FA 1090
MTHHYPTDDIKIKEVKELLPPIAHLYELPISKEASGLVHRTRQEISDLVHGRDRRLLVIIGPCSIHDPKAALEYAERLLKLRKRYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAGHVSEAVEQLRAAGVTDKLMIDCSHANSRKDYTRQMEVAQDIADQLEQDGGNIMGVMVESHLVEGRQDKPEVYGKSITDACIGWGATEELLALLAGANTKRMARAG

SEQ ID NO: 1315 - DNA, 1089 bp, Pseudomonas syringae pv. syringae B728a
  CDS (1)..(1089): transl_table=11
atgagtaacacgatggctgatttaccgattgacgacctcaacgttgcctccaacgagactctgatcactccggatcagctcaagcgcgacatccccctgaccgatgctgccctgcagaccgtcagccagggccgcgaagtgattcgcaacattctcgatggccatgaccaccgcctgttcatcgtgatcggcccgtgctcgatccacgacctcaaggcagccaaggagtacgccgagcgtctcaaggcgctggcggcggaagtgtctgacacgctgtatctggtgatgcgcgtctacttcgagaagccgcgcaccacggtgggctggaaaggcctgatcaacgacccgtacctggatgactcgttcaagatccaggatggcctgcacatcggtcgccagttgctgctggatctggccgagatgggtctgcccaccgccaccgaagccctggacccgatctccccgcagtatctgcaggacctgatcagctggtcggcaatcggcgcgcgcaccacagaatcccagactcaccgcgagatggcttcgggcctgtcctcggcagtcggtttcaagaacggtaccgacggcggcctgacggttgccatcaacgccttgcaatcggtgtcgagcccgcatcgtttcctgggtatcaaccaggaaggcggcgtgtcgatcgtgaccaccaaaggcaatgcctacggtcatgtggtgctgcgcggcggcaacggcaagcccaactatgactcggtcagcgttgcgctctgcgagcaggcgctgaacaagtccggcattcgcccgaacatcatggtcgactgcagccatgccaactccaacaaggacccggcgctgcaaccgctggtgatggaaaacgtcgccaaccagatcctggaaggcaacgaatcgatcatcggcctgatggtcgagagccatttgaactggggctgccaggcgattcccaaggacctgtcggaattgcagtacggcgtgtcgattaccgatgcctgcatcgattggcaaagcactgaaaagaccctgcgcagcatgcacgcgaaactcaaggatgtgctgccagctcgcaagcgcaagtaa

SEQ ID NO: 1316 - protein, 362 aa, Pseudomonas syringae pv. syringae B728a
MSNTMADLPIDDLNVASNETLITPDQLKRDIPLTDAALQTVSQGREVIRNILDGHDHRLFIVIGPCSIHDLKAAKEYAERLKALAAEVSDTLYLVMRVYFEKPRTTVGWKGLINDPYLDDSFKIQDGLHIGRQLLLDLAEMGLPTATEALDPISPQYLQDLISWSAIGARTTESQTHREMASGLSSAVGFKNGTDGGLTVAINALQSVSSPHRFLGINQEGGVSIVTTKGNAYGHVVLRGGNGKPNYDSVSVALCEQALNKSGIRPNIMVDCSHANSNKDPALQPLVMENVANQILEGNESIIGLMVESHLNWGCQAIPKDLSELQYGVSITDACIDWQSTEKTLRSMHAKLKDVLPARKRK

SEQ ID NO: 1317 - DNA, 1089 bp, Haemophilus influenzae 86-028NP
  CDS (1)..(1089): transl_table=11
atggctaaagagaaaattgaaattgtcgtggcaaacgacgatacgcgaattgaaaaagtcgatcaggtgttaccacccattgccttattagaaaaatacccagcaagtgaacaggctgcggcgttagtgaagcaaactcgtcatgaggcacataatattattcatggtaaagatgatcgtttattagtcgtgattgggccttgctctattcatgatccgaaagttgccattgaatatgcgactcgtttaaaaccattacgtgaaaaatacaaagatagccttgaaattattatgcgtgtgtattttgagaaaccgcgtacaacggtgggttggaaaggtttaattaatgatccatatttgaatgatacttatcgtttaaatgatgggttacgcattgcacggaaattactttcagatattaatgatcttggtgtgcctgcagcgggcgagtttttagatatgattacacctcagtatttggcagattttatgagctggggggcgattggggctagaacaacagaatcacaagttcatcgtgagttggcttcaggtttatcttgtgctgttgggtttaaaaatgccactaatggtggtgtgaaagtcgctttagatgcaattggtgcggcggaagctccccactatttcttatctgtcactaaatttggtcattctgcaattgtttctacaaaagggaatgaagattgccatattattttacgaggtggagataaaggtcctaactatagtgctgaagatgtagaaaaagtttgtgctgatattgaaaaaacagggcgtattccacacgttatggttgattttagccatgcaaacagcagtaaacaatataaaaagcaaatggatgtttgccaagacgtatgtaatcagattgcatttggttctaaacaaatctttggcgtaatggtggaaagccatttagtggaaggtcgtcaagatttagttgatggcaaagcgcagacttatggacaaagtattacggatgcgtgcattggatgggaagattctgaaagattattgcaacaactttctgatgcagttattgctagacgtaaagcgacgagtaattaa

SEQ ID NO: 1318 - protein, 362 aa, Haemophilus influenzae 86-028NP
MAKEKIEIVVANDDTRIEKVDQVLPPIALLEKYPASEQAAALVKQTRHEAHNIIHGKDDRLLVVIGPCSIHDPKVAIEYATRLKPLREKYKDSLEIIMRVYFEKPRTTVGWKGLINDPYLNDTYRLNDGLRIARKLLSDINDLGVPAAGEFLDMITPQYLADFMSWGAIGARTTESQVHRELASGLSCAVGFKNATNGGVKVALDAIGAAEAPHYFLSVTKFGHSAIVSTKGNEDCHIILRGGDKGPNYSAEDVEKVCADIEKTGRIPHVMVDFSHANSSKQYKKQMDVCQDVCNQIAFGSKQIFGVMVESHLVEGRQDLVDGKAQTYGQSITDACIGWEDSERLLQQLSDAVIARRKATSN

SEQ ID NO: 1319 - DNA, 1077 bp, Pseudomonas fluorescens Pf-5
  CDS (1)..(1077): transl_table=11
atggctgatttaccgatcaacgaccttaacgtcgcctccaacgagaccctgatcacccctgatcaactcaaacgagacatcccgctgagcgacaccgccttgcgcaccgtgaccaagggtcgcgaagtgatccgcaatatcctcgacggcactgatcaccgcctgttcatcgtcattgggccctgctcgatccacgacatcaaggcagcccacgaatacgccgagcggctcaaggcactggcggctgaagtctccgacaccctgtacctggtgatgcgcgtttatttcgagaaaccgcggaccaccgtcggctggaaaggcctgatcaacgacccttacctggacgactcgttcaagatccaggacggcctgcacattggtcgtcagttgctgctggacctggctgaaatgggcctgcctactgccactgaagccctggacccgatctccccgcaatacttgcaggacctgatcagctggtcggccattggtgcacgtaccaccgaatcccagactcaccgcgaaatggcttcgggcctgtcctcggccgtgggcttcaagaacggcaccgacggtggcctgactgtggcaatcaacgccttgcagtcggtttccagccctcaccgtttcctggggatcaacccccagggcggcgtgtcgatcgtcaccaccaaaggcaacgcctacggccacgtggtactgcgcggcggcaacggcaagcccaactatgactcggtcagcgtcgccgtctgcgagcaggccctgagcaaggccaagatcaagccaaacatcatgatcgactgtagccacgccaactccaacaaggacccggcactgcagccgctggtcatggaaaacgtggctaaccagatcctcgagggcaaccagtcgatcatcggcctgatggtggaaagtcacttgaactggggttgccaggcgattccgaagaacctgtcggaactgcagtacggcgtatcgatcaccgatgcctgcatcgactgggaaagtaccgagaagaccctgcgcggcatgcacgccaagctcaaggacgtcttgccgaaacgcgatcgcagctga

SEQ ID NO: 1320 - protein, 358 aa, Pseudomonas fluorescens Pf-5
MADLPINDLNVASNETLITPDQLKRDIPLSDTALRTVTKGREVIRNILDGTDHRLFIVIGPCSIHDIKAAHEYAERLKALAAEVSDTLYLVMRVYFEKPRTTVGWKGLINDPYLDDSFKIQDGLHIGRQLLLDLAEMGLPTATEALDPISPQYLQDLISWSAIGARTTESQTHREMASGLSSAVGFKNGTDGGLTVAINALQSVSSPHRFLGINPQGGVSIVTTKGNAYGHVVLRGGNGKPNYDSVSVAVCEQALSKAKIKPNIMIDCSHANSNKDPALQPLVMENVANQILEGNQSIIGLMVESHLNWGCQAIPKNLSELQYGVSITDACIDWESTEKTLRGMHAKLKDVLPKRDRS

SEQ ID NO: 1321 - DNA, 1083 bp, Psychrobacter arcticus 273-4
  CDS (1)..(1083): transl_table=11
atgataacaaccgctacccataatgcagaaattgacgacgtgaatattgaaaaatttattccattaataacacccaatgagctaaaaaccgaactgcctttatcaaacgaagcctataaaaccgttttaaatggtcgtcacactatccaaaacatcttggatggcaaagacaagcgtctgtttgtggttattggtccctgctctattcatgacatcaaagccgctcacgaatatgctgatcgcttagcgatattggcgaaagagattgaagacagcatattcgttgtgatgcgtgtctattttgagaagccgcgcacgaccgttggctggaagggtatgattaacgaccctgatatgaatgacagctttgacattgaaaaaggtctgcgtactgcccgtaagctactgcttgatctcaatgaaaaagggttgccttgcgccaccgaagcgcttgacccgaacacgccgcagtacatgcaggacttgatcagctggtcagcgattggcgcacgtacgactgaaagccaaacacaccgtgagatgagctcaggcttatcatgcccagttggctttaagaatggtaccgatggtggtatgactgtcgcggtcaacgccatgcaagcggtaaaagcgggtcatagctttttaggtctgtcatcagatggcaaagtatctatcatcaaatctaaaggcaacccttatgctcacgtggtattacgtggtggtaacggtaagcccaactacgatgaaacggcagttgctcaagtagaagacgcacttgctaaaggcaaaaccagtagcaaaattatgattgactcaagtcatgccaattcaggtaaagacccttacctgcaaccgatggtcattcaaaacgtcgcggagcaaattaaaaatggcaacaagtctatcatcggtatgatgattgagagtcatttaaaaggcggtcgccaagagctaactgctgatttggacgcgctcgaatacggcatgtcgattactgatggttgcctagattgggacagcacggtcacagcactacacaatttacgtgatatggtcaaagacatcctacctaatcgttaa

SEQ ID NO: 1322 - protein, 360 aa, Psychrobacter arcticus 273-4
MITTATHNAEIDDVNIEKFIPLITPNELKTELPLSNEAYKTVLNGRHTIQNILDGKDKRLFVVIGPCSIHDIKAAHEYADRLAILAKEIEDSIFVVMRVYFEKPRTTVGWKGMINDPDMNDSFDIEKGLRTARKLLLDLNEKGLPCATEALDPNTPQYMQDLISWSAIGARTTESQTHREMSSGLSCPVGFKNGTDGGMTVAVNAMQAVKAGHSFLGLSSDGKVSIIKSKGNPYAHVVLRGGNGKPNYDETAVAQVEDALAKGKTSSKIMIDSSHANSGKDPYLQPMVIQNVAEQIKNGNKSIIGMMIESHLKGGRQELTADLDALEYGMSITDGCLDWDSTVTALHNLRDMVKDILPNR

SEQ ID NO: 1323 - DNA, 1059 bp, Colwellia psychrerythraea 34H
  CDS (1)..(1059): transl_table=11
atgtatcaaactgacgatgtacgcatcaataaaattaaagatcttttacctccaattgctttattggaacgatttcctgcgtcagagcaagcaactaaatcagtcgttgctggcagaactgctattcacaatattctcaaaggtaaagatgatcgcttattagtggttattggaccttgttctatacatgatcctgaagcggcacttgaatacgggcaacgcttagtaaagcttcgtgaagagtacaaagatagtcttgagattgtcatgcgtgtttattttgaaaaaccacgtactaccgttggttggaagggcttaattaatgacccttatatggataacagctttaaattgaatgatggtttacgtttaggtcgtaagttactagtagaactaaatgaccttggtttacctacggcgggcgagttcttagatatgatcacaccgcaatatatggcagatcttatgtgttggggagccattggcgctcgtactactgaatcacaagttcaccgtgaattagcatcaggactttcatgtccagttggatttaaaaacggaactgacggtaccattaaaattgcgattgatgccataggctcagcttctgcatcacatcactttttatcagttacaaaatttggccatgctgccattgttgaaacgacaggtaatagtgattgtcatatcattttacgtggtgggagaacgactaattttgatgctgatagtgttaaagcggtaaccgagcaattaactacctctgatttaaacactaaggtaatgattgattttagccatgctaactcgagcaaaaaatttgaaaatcaaatgatagtctctactgatgtcagtgagcaaattagccaaggcaatgaaaatatctttggtgttatggttgaaagtcatttagttgaaggtaatcaaagtctagttaaaggtagagcagccgtgtatggacaaagtattactgatgcttgtattggctgggatgatactgaaaaattattaagccagttaaatggagccgttgttagtcgccgaagcgttatagactaa

SEQ ID NO: 1324 - protein, 352 aa, Colwellia psychrerythraea 34H
MYQTDDVRINKIKDLLPPIALLERFPASEQATKSVVAGRTAIHNILKGKDDRLLVVIGPCSIHDPEAALEYGQRLVKLREEYKDSLEIVMRVYFEKPRTTVGWKGLINDPYMDNSFKLNDGLRLGRKLLVELNDLGLPTAGEFLDMITPQYMADLMCWGAIGARTTESQVHRELASGLSCPVGFKNGTDGTIKIAIDAIGSASASHHFLSVTKFGHAAIVETTGNSDCHIILRGGRTTNFDADSVKAVTEQLTTSDLNTKVMIDFSHANSSKKFENQMIVSTDVSEQISQGNENIFGVMVESHLVEGNQSLVKGRAAVYGQSITDACIGWDDTEKLLSQLNGAVVSRRSVID

SEQ ID NO: 1325 - DNA, 1053 bp, Colwellia psychrerythraea 34H
  CDS (1)..(1053): transl_table=11
atgaccattaaaactgatgaattacgcaccacgctaattgaaaatttagtctcccctgcacagcttgctgaagaaattcctttaagtacggcaactgcagattttattatgcaaagccgcaaagaaattgaagcggtcattagtggtgaagacaagcgtttattagtcattatcggcccttgctctattcacgacaccacagctgcaattgattacgctaaaaaactcaccgtattacgtgacaagtataaaaatgaattactcattgttatgcgcgtttactttgaaaaaccacgtactaccgttggttggaaaggtttaattagcgatcctgatttagacaagtcatttcatgttgccaaagggttaaaacttgcccgtaacttattagtcgaaattaatgacttaggactacctgcaggtactgaatttttagatatggttaccggtcagtatatttctgatttaatcagctggggcgctattggtgcgcgtacaactgaaagccaagttcaccgagaattagcttctgcgctgtcttgcccagttggctttaaaaatggtactgacggtaatgttaaaattgcccttgacgctattcaagcttcaagcgttccacacgtattatattctccggataaaagtggtcaaatgtgtatttaccaaacccatggtaatccatttgctcatgtaattttacgtggtggcaaagtacctaattatcatgctgctgatattaaagatactcgccagagacttgaaaaagcatcattaccgcaaagtattatggttgattgtagccatggtaatagctataaagatcacaataaacaaattgatgttgcgcgctctattgctgatcagataagccaaggtgaagacagcctttttggtgtcatgattgaaagctttattgaagaaggtaatcaagcagtaaaggctggtacgccgttaacctacggaaaaagtattactgatgcttgtattgatttaactgtcagtgacactatattagcgttattggctgattcggtgaaaacacgtttcgaataa

SEQ ID NO: 1326 - protein, 350 aa, Colwellia psychrerythraea 34H
MTIKTDELRTTLIENLVSPAQLAEEIPLSTATADFIMQSRKEIEAVISGEDKRLLVIIGPCSIHDTTAAIDYAKKLTVLRDKYKNELLIVMRVYFEKPRTTVGWKGLISDPDLDKSFHVAKGLKLARNLLVEINDLGLPAGTEFLDMVTGQYISDLISWGAIGARTTESQVHRELASALSCPVGFKNGTDGNVKIALDAIQASSVPHVLYSPDKSGQMCIYQTHGNPFAHVILRGGKVPNYHAADIKDTRQRLEKASLPQSIMVDCSHGNSYKDHNKQIDVARSIADQISQGEDSLFGVMIESFIEEGNQAVKAGTPLTYGKSITDACIDLTVSDTILALLADSVKTRFE

SEQ ID NO: 1327 - DNA, 1068 bp, Colwellia psychrerythraea 34H
  CDS (1)..(1068): transl_table=11
gtgccgaccagctcaaataacattcatgtgaatgctgagcatgtattaattaccccagaagcgttacgtgctgaattaccactttcagaagaaggtcgtgagtttgtacagcagtcgcgtaaaacgattagtgacatcatccacaagcgagatcctcgtttgctcgttatttcaggtccgtgctctgtacatgatgttgaagcagctaaagattatgctcgtcagttaaaggtgctacacaataaataccaaggctcactattcattgttatgcgtgtttattttgaaaagccaagaacaacagtgggttggaaaggtttgatcaacgaccctcatatggatggtacgtttgatgttgaaacgggccttcgaaaagcacgtgaattgattctttacttaacagaacttggtttgcctttggcaacggaagcgcttgatccgattagcccgcaataccttgcagaagcatttagctggtcagctattggcgcacgtaccactgaatcacaaactcacagagaaatggcaagtggtttatccatgccaataggttttaaaaatggtactaacggtagcctaagtgttgcagtaaacgcattacaatcagcagcttcgccacatcactttatgggtataaaccgtcaagggcaggttgctttaatccaaactagcggtaaccctgacggccatgttattttacgaggtggtgcaacgcctaattacgatgcaaaaagtattgcagagtgtgagcaagccttagctaaacaaggtattgccccaggtattattgttgactgtagtcacggtaactcaagtaaagattacactcgacaaccactggtaacacaagatgttgtcgaacaaatttgtgcgggtaataaatcaattattggtataatgttagagagtaatattaacgcgggtaaccaaagcagtgatttagcaaaagaagacttagcttacggtgtatctgttaccgatgcttgtattgattttgctgaaaccgaacaactattagatgatgctaatgcacgcctatcgggttgtttaactgcacgtaccgcctaa

SEQ ID NO: 1328 - protein, 355 aa, Colwellia psychrerythraea 34H
MPTSSNNIHVNAEHVLITPEALRAELPLSEEGREFVQQSRKTISDIIHKRDPRLLVISGPCSVHDVEAAKDYARQLKVLHNKYQGSLFIVMRVYFEKPRTTVGWKGLINDPHMDGTFDVETGLRKARELILYLTELGLPLATEALDPISPQYLAEAFSWSAIGARTTESQTHREMASGLSMPIGFKNGTNGSLSVAVNALQSAASPHHFMGINRQGQVALIQTSGNPDGHVILRGGATPNYDAKSIAECEQALAKQGIAPGIIVDCSHGNSSKDYTRQPLVTQDVVEQICAGNKSIIGIMLESNINAGNQSSDLAKEDLAYGVSVTDACIDFAETEQLLDDANARLSGCLTARTA

SEQ ID NO: 1329 - DNA, 1077 bp, Pseudomonas syringae pv. phaseolicola 1448A
  CDS (1)..(1077): transl_table=11
atggctgatttaccgattgacgaccttaacgttgcctccaacgagactctgatcaccccggatcagctcaagcgcgacatccctctgaccgacgccgccctgcacaccgtcagccagggccgcgaggtgattcgcaacatcctcgatggcaatgatcaccgcctgttcatcgtgatcggcccctgctcgatccacgacctgaaggcagccaaggaatacgccgagcgcctcaaggcattggcggcagaagtgtccgacacgctgtatctggtcatgcgcgtctatttcgagaagccacgtactaccgtgggctggaaaggcctgatcaacgacccgtacctggatgactcgttcaagatccaggatggcctgcacatcggtcgccagttgctgctggacctggctgaaatgggcttgccaaccgccaccgaagcactggacccgatctccccgcagtatatgcaggacctgatcagctggtcggccattggcgcgcgcaccaccgaatcccagactcaccgcgagatggcttccggcctgtcgtcggcagtcggtttcaagaacggcaccgacggcggtctgaccgttgccatcaacgccttgcaatcggtctcgagcccgcaccgcttcctcggtatcaatcaggaaggtggcgtatcgatcgtgaccaccaagggcaatgcctacggccatgtcgtactgcgcggcggcaatggcaagcccaactatgattcggtcagcgtcgccctgtgcgaacaggcccttaacaagtccggcattcgcccgaacatcatggtcgactgcagccacgccaactccaacaaggacccggccctgcagccgctggtgatggaaaacgtcgccaaccagattctggaaggcaacgaatcgatcatcggcctgatggtcgagagtcacttgaactggggctgtcaggcgattcagaaggacctgtcggaattgcagtacggcgtatccattaccgatgcctgcatcgattgggaaagcactgaaaaaaccctgcgcagcatgcacgcgaaactcaaggctgtactgcccgcccgcaagcgcaagtaa

SEQ ID NO: 1330 - protein, 358 aa, Pseudomonas syringae pv. phaseolicola 1448A
MADLPIDDLNVASNETLITPDQLKRDIPLTDAALHTVSQGREVIRNILDGNDHRLFIVIGPCSIHDLKAAKEYAERLKALAAEVSDTLYLVMRVYFEKPRTTVGWKGLINDPYLDDSFKIQDGLHIGRQLLLDLAEMGLPTATEALDPISPQYMQDLISWSAIGARTTESQTHREMASGLSSAVGFKNGTDGGLTVAINALQSVSSPHRFLGINQEGGVSIVTTKGNAYGHVVLRGGNGKPNYDSVSVALCEQALNKSGIRPNIMVDCSHANSNKDPALQPLVMENVANQILEGNESIIGLMVESHLNWGCQAIQKDLSELQYGVSITDACIDWESTEKTLRSMHAKLKAVLPARKRK

SEQ ID NO: 1331 - DNA, 1080 bp, Dechloromonas aromatica RCB
  CDS (1)..(1080): transl_table=11
atgatgccgcaaagtaaaccgaataccgacgaccttcgcatcaaggaaatcaaggagctggtgccgccagcccacgttttccgcgagtatccggtgtccactcgggcggcgcaaacgacctatgtcgcccgccaggcaattcaccgcgtgctgcatggcgccgacgaccgcctgctggtcgtcatcggcccctgctcgatccatgactacgaactggccatggattacgccaagaaactggccaaggaagccgagaaatacgccgaggacctgatcgtcgtcatgcgcgtctattttgaaaagccgcggaccacagttggctggaaaggcctgatcaacgatccgcgcatggacaacaccttccgcatcaacgaaggcctgcgtctggcccgccgcatcctgcttgaggtcaatgagctggacctgccttgcgccaccgagttcctcgacaccatcacgccgcaatacaccgccgacctgatcgcctggggcgccatcggtgcgcgcaccaccgagtcgcaggtgcaccgcgagctggcttccggcctttcctgcccggtcggtttcaagaacggcaccgacggcaacatgcgcattgccgtggatgcgatccgctcggccaactcgccacaccatttcctgtcggtgaccaagtccggccacaccgccatcgtgtcgacgatgggcaacgaggactgccacgtcatcctgcgcggcggcaaggaaccgaactacgacgcggccagcgtcgatgccgcatgcaccgaaatcgctaaatccggcctcgccgcccggctgatggtcgatttctcgcacggcaacagccgcaagcaatacaagctgcaaatggaagtctgcgacagcgtggccgagcagatcgccggtggcgaagaccgcattgttggcgtcatggtcgaatcgcacctcgtcgaaggccgccaggacatctcgccggacaagccgctgacctacggccagagcgtgactgatgcctgtatcaactgggatgacagcctgaaagtgctcgagaaactggcagctgccgtcagggcaagacgagtcgccgaagcgtcagagtaa

SEQ ID NO: 1332 - protein, 359 aa, Dechloromonas aromatica RCB
MMPQSKPNTDDLRIKEIKELVPPAHVFREYPVSTRAAQTTYVARQAIHRVLHGADDRLLVVIGPCSIHDYELAMDYAKKLAKEAEKYAEDLIVVMRVYFEKPRTTVGWKGLINDPRMDNTFRINEGLRLARRILLEVNELDLPCATEFLDTITPQYTADLIAWGAIGARTTESQVHRELASGLSCPVGFKNGTDGNMRIAVDAIRSANSPHHFLSVTKSGHTAIVSTMGNEDCHVILRGGKEPNYDAASVDAACTEIAKSGLAARLMVDFSHGNSRKQYKLQMEVCDSVAEQIAGGEDRIVGVMVESHLVEGRQDISPDKPLTYGQSVTDACINWDDSLKVLEKLAAAVRARRVAEASE

SEQ ID NO: 1333 - DNA, 1062 bp, Thermobifida fusca YX
  CDS (1)..(1062): transl_table=11
atgtcgaggactaacgacacacgtgtcgtcagctaccagccactcgtcgctccccacgacctcctggccgaactgccgatgggccccgagcgcacggcactagtcgaggaagccagagccgaggtgaaaaaagtactcgatggggaggacgaccggctgctggttgtcgtgggaccgtgctccgtgcacgaccccgagtccgccctggactatgcacgccgtctcaaggcgctgatcccgtccgtctcctctgaattgtgcgtggtcatgcgggtgtacttcgaaaagccgcgcaccaccctgggatggaagggcctgatcaacgaccccgggctcgacgggagcttcgacgtccaccggggcctgcggaccgcacgcaaactgctgctcgacatcggctccctgggcgtgcccgccggcaccgaattcctcgacccgatcaccccgcagtacatcgcggacgcggtgacctggggagcgatcggtgcgcgcaccacggaaagccaggtgcaccgccagctcagcagcggcctcagcatgcccgtgggcttcaagaacggcaccgacggcaacgtccaggtcgccgtggacgcctgccgggccgcagccagctcgcacaccttcttcggcgtggacccgagcggcagcggcgcggtcgtgtccacctccggcaacccggactgccacgtcatcctgcggggcggccgctccggccccaactacgacgcggacagtgtcgccgccgcgctcgacaccatcgaggccgcgggcctgccgcgccgcctcatgatcgacgccagccacgccaacagcggcaaggaccacctgcgccagccgggcgtggcccaggccatcgccgcccaagtcgcggaaggccagaccggaatcatcggggtcatgctggagagcttcctggtgcccggcgcccagaagctcggcgacccggccaagctcacctacggccagagcattacggacaagtgcatgggttgggagaccaccgaggaggtcctggcccatctggccgacgccgtgcgcagccgccgcaaggccacgtcctaa

SEQ ID NO: 1334 - protein, 353 aa, Thermobifida fusca YX
MSRTNDTRVVSYQPLVAPHDLLAELPMGPERTALVEEARAEVKKVLDGEDDRLLVVVGPCSVHDPESALDYARRLKALIPSVSSELCVVMRVYFEKPRTTLGWKGLINDPGLDGSFDVHRGLRTARKLLLDIGSLGVPAGTEFLDPITPQYIADAVTWGAIGARTTESQVHRQLSSGLSMPVGFKNGTDGNVQVAVDACRAAASSHTFFGVDPSGSGAVVSTSGNPDCHVILRGGRSGPNYDADSVAAALDTIEAAGLPRRLMIDASHANSGKDHLRQPGVAQAIAAQVAEGQTGIIGVMLESFLVPGAQKLGDPAKLTYGQSITDKCMGWETTEEVLAHLADAVRSRRKATS

SEQ ID NO: 1335 - DNA, 1071 bp, Prochlorococcus marinus str. NATL2A
  CDS (1)..(1071): transl_table=11
atgtccacctcatcatatttttcaatggtggatagcacctccgaccttcatgtggtcgagactcgtccattaatgtcaccagcattaattcatagagatttgcctttagataaggcatcctctggagttgtctctactactcgcaataagattcaatcaattcttcatggtaatgatccaagaattttggtcattgttggaccgtgttcggttcatgatgttgatgcggccattgaatatgcaaatcgtttagccccattgagggagagatatagtcaaaagcttgagattgttatgcgtgtttactttgagaaaccacgcacaactgttggctggaaaggacttattaatgaccctcatcttgataattcttacgatattaatactggcttaagaaaggcaagaggtctattacttgatttagccaaagcaggaatgccggctgcaactgaattacttgatccagttgttcctcaatatattgctgatttaattagttggactgctattggagcaagaacgacagagagtcagactcatcgtgaaatggcgtctggattatcaatgccggttggttataagaatggtactgatgggacagctacgattgcgattaatgcaatgcaagcggcctcaaaacctcatcattttttaggaattaatcatgatggtcatgcctcaatagttagtactacaggtaatccaaatggtcatcttgttttaagaggtggtaagaatggaactaactaccatcttgatgcaattaatttaattgcagatgaattagcacaatttaatatgcctggaaaagtgatggttgattgtagtcatggtaattctaataaagattttcgtagacaatcagaagttttaaaagacgtagcagcacagataagaggtggatcaaagaatctaatgggcgtaatgatagaaagtcatcttgttgagggtaatcagaaattaaattcagatttgtcaaaacttacctatgggcaaagtgttacggatgcatgcataaacttttctacaactgaaattttattagaagaactagctgaatcggtcaaataa

SEQ ID NO: 1336 - protein, 356 aa, Prochlorococcus marinus str. NATL2A
MSTSSYFSMVDSTSDLHVVETRPLMSPALIHRDLPLDKASSGVVSTTRNKIQSILHGNDPRILVIVGPCSVHDVDAAIEYANRLAPLRERYSQKLEIVMRVYFEKPRTTVGWKGLINDPHLDNSYDINTGLRKARGLLLDLAKAGMPAATELLDPVVPQYIADLISWTAIGARTTESQTHREMASGLSMPVGYKNGTDGTATIAINAMQAASKPHHFLGINHDGHASIVSTTGNPNGHLVLRGGKNGTNYHLDAINLIADELAQFNMPGKVMVDCSHGNSNKDFRRQSEVLKDVAAQIRGGSKNLMGVMIESHLVEGNQKLNSDLSKLTYGQSVTDACINFSTTEILLEELAESVK

SEQ ID NO: 1337 - DNA, 1080 bp, Ralstonia eutropha JMP134
  CDS (1)..(1080): transl_table=11
atgctgaagaacaccgacgacctgcgcattcgtgaactcaaggaactgctgccgcccgcgcacctgatccgcgagttcgcctgctccgaaaaggcttcggacgtgatctacgccgcgcgccagtccatgcatcggatcctgcacggcatggatgaccgcctgatcgtcatcatcggtccgtgctcgatccacgacaccaaggccgcgctcgaatacgcgaagctgctgaaggtccagcgcgagcgctttgccaacgagcttgaaatcgtgatgcgggtctacttcgaaaaaccgcgtaccacggtgggctggaagggcctgatcaacgacccgttcatggacggcagcttcaagatcaacgacggcctgcgcaccgcgcgcgaactgctgctgaatatcagcgaactaggcgtgccgaccggcaccgagtatctcgacatgatcagcccgcagtacatcgccgacctcgtgagctggggcgcgatcggcgcgcgtacgacggagtcgcaggtgcaccgcgagctggcgtcgggactgtcgtgcccggtaggcttcaagaacggcaccgatggcaatgtgaagatcgccgtcgatgctatcaaggctgcatcgcagccgcaccatttcctgtcggtgaccaaaggcggccattcggcgatcgtgtcgacctccggcaacgaggactgccacattatcctgcgcggcggcaaggcgccgaactacgacgccgcgagcgtgcaggaagcctgcgatgcgatcgccaaggcgggcctggccgctcgcctgatgatcgatgcctcgcacgccaacagcagcaagaagcacgagaatcagattcccgtgtgcgaagacatcggccgccagctcgccgccggtgatgaccgcatcgtcggcgtgatggtcgaatcgcacctggtggcaggccgtcaggaccatgcccagggtacgccggtagaaagcctgacctacggccagtcggtaaccgacgcgtgcatcggctgggacgattcggtcaaggtgctggaaacgctggccgaggccgtcaaggcccgccgactggcaagcggcagcggcaactga

SEQ ID NO: 1338 - protein, 359 aa, Ralstonia eutropha JMP134
MLKNTDDLRIRELKELLPPAHLIREFACSEKASDVIYAARQSMHRILHGMDDRLIVIIGPCSIHDTKAALEYAKLLKVQRERFANELEIVMRVYFEKPRTTVGWKGLINDPFMDGSFKINDGLRTARELLLNISELGVPTGTEYLDMISPQYIADLVSWGAIGARTTESQVHRELASGLSCPVGFKNGTDGNVKIAVDAIKAASQPHHFLSVTKGGHSAIVSTSGNEDCHIILRGGKAPNYDAASVQEACDAIAKAGLAARLMIDASHANSSKKHENQIPVCEDIGRQLAAGDDRIVGVMVESHLVAGRQDHAQGTPVESLTYGQSVTDACIGWDDSVKVLETLAEAVKARRLASGSGN

SEQ ID NO: 1339 - DNA, 1134 bp, Ralstonia eutropha JMP134
  CDS (1)..(1134): transl_table=11
atgaataccccacaggcatccacaaacagcatcggcgagggctggccacatccctccgaccgcaccagcggcaccgacgatgcccgcgtcgacgacatcattccgctgcccccgcccgagcatctgatccggttcttccccattgccgggacgccgatcgaatcgctggtcacggcaacgcggcagagcatttcccggatcctgcacggccaggatgaccgcctgctcgtgatcatgggaccgtgctcgatccacgatccgcgcgccgcgctcgactacgcgcagcgcttgatggcacagcgcgtgcgctacgcggatacgctcgaaatcgtgatgcgtgtgtacttcgagaagccccgcaccaccgtgggctggaagggtctgatcaacgacccgtatctcgacgaaagctaccggatcgacgaggggcttcggatggcgcgccatctgctgctggacatcaaccgcctcgggctaccggcggccggcgagttcctggatgtcatctcgccgcagtacatcggcgacctgatcagctggggcgcaatcggcgcccgcacgacggaaagccaggtgcaccgggaactggcgtcgggcacctcggcaccgatcggattcaagaacggcaccgacggcaatatcaagatcgccatcgatgcaatccaggccgcctcccgtccgcatcacttcctgggcgtccataagaacgggcaggtcgcgaccgttcacacccggggcaaccccgactgccacgtcattctgcgcggcggcaaggtgccgaactatgatgccgattccgtggcagccgcctgcaaggatctcgacgcggccggactggaccgccggctgatggtcgattgcagccacgccaacagcagcaagcagcacttgcggcagatcgacgtcgcacgcgacgtagcgcggcaggtcagcggcggcagccggtcagtgtttggcgtgatggtcgaaagccatctgatcggtggtgcgcaaaaattcacgccggggcagcacaacccgtcggaactgacgtacgggcagagcattaccgacgcctgcatcggctgggacgactccctcgcggtgctcgacatgcttgccgaggcggtcgctgcgcgcaggcagaaagcctga

SEQ ID NO: 1340 - protein, 377 aa, Ralstonia eutropha JMP134
MNTPQASTNSIGEGWPHPSDRTSGTDDARVDDIIPLPPPEHLIRFFPIAGTPIESLVTATRQSISRILHGQDDRLLVIMGPCSIHDPRAALDYAQRLMAQRVRYADTLEIVMRVYFEKPRTTVGWKGLINDPYLDESYRIDEGLRMARHLLLDINRLGLPAAGEFLDVISPQYIGDLISWGAIGARTTESQVHRELASGTSAPIGFKNGTDGNIKIAIDAIQAASRPHHFLGVHKNGQVATVHTRGNPDCHVILRGGKVPNYDADSVAAACKDLDAAGLDRRLMVDCSHANSSKQHLRQIDVARDVARQVSGGSRSVFGVMVESHLIGGAQKFTPGQHNPSELTYGQSITDACIGWDDSLAVLDMLAEAVAARRQKA

SEQ ID NO: 1341 - DNA, 1077 bp, Thiobacillus denitrificans ATCC 25259
  CDS (1)..(1077): transl_table=11
atgtctgccacccgaaccgacgacacccgcatcgagcaaagcggcgaactgcttgcgccgatgcagatcatgcgcgagctgcgcgcgagcgaggccgtccatgcgcacgtcgcgcgcgcgcgcggcgcgatccacgacgtcctgcgtggcgccgacgaccgcatgttcgtcgtcgtcggcccctgctcgatccacgaccccgaggccgcgctcgactacgcgcgcaagctcaagcccctcgctgacgagctcgcgcacgaactcatcgtcgtgatgcgggtgtatttcgagaagccgcgcacgaccgtcggctggaaagggctcatcaacgatccccatctcgacgagagcttcgacatcaacgagggcctgcggctcgcgcgaaaattgttgctggagatcaacgaaatcggactgccctgtgcgaccgaattcctcgacctgatctcgccgcagtacatcgccgacctcgtgagctggggtgcgatcggtgcgcgcacgaccgagtcgcagtcgcatcgccagctcgcgtcggggctgtcgtgtcccgtcggcttcaagaacggcaccgacggcagtctgcggatcgcggtcgacgcgatcaaggccgcggcggcgcgccaccatttcatctcggtcaccaagtcgggccacgtcggcgtcttcagcacctcgggcaacgaggacgcccacgtcatcctgcgcggcggcaaggcgccgaactacgacgcggcgagcgtcaatctcgcgagcggcgagctggcggcggcgggtctcagacagcaactgatgatcgatttctcgcacgccaattcgagcaagcagtaccagcgccagatcgaagtcgccgccgacgtcgccgctcaaatcgcgggcggcgacacccgcatcatcggggcgatggtcgagagccacctcaatccgggccgtcaggacctcgtcccggggcagtcgctcgagtatgcgaagtcgatcaccgacgcgtgcatcgggtgggaggacacgattcccctgctgcgcacgctcgccgacgcggtgaaaaaacgccggctggccgcgccggcggatgaggaatga

SEQ ID NO: 1342 - protein, 358 aa, Thiobacillus denitrificans ATCC 25259
MSATRTDDTRIEQSGELLAPMQIMRELRASEAVHAHVARARGAIHDVLRGADDRMFVVVGPCSIHDPEAALDYARKLKPLADELAHELIVVMRVYFEKPRTTVGWKGLINDPHLDESFDINEGLRLARKLLLEINEIGLPCATEFLDLISPQYIADLVSWGAIGARTTESQSHRQLASGLSCPVGFKNGTDGSLRIAVDAIKAAAARHHFISVTKSGHVGVFSTSGNEDAHVILRGGKAPNYDAASVNLASGELAAAGLRQQLMIDFSHANSSKQYQRQIEVAADVAAQIAGGDTRIIGAMVESHLNPGRQDLVPGQSLEYAKSITDACIGWEDTIPLLRTLADAVKKRRLAAPADEE

SEQ ID NO: 1343 - DNA, 1131 bp, Anabaena variabilis ATCC 29413
  CDS (1)..(1131): transl_table=11
atgatgaatttgtgttgtacatttcatctacaatatgtatacccaatctgcctaaaatcctacccagacaatctagagcaatcctccatgcacaataaattaactaacgcaaatattgaaaattatcacgttctcttaactccaaacgaagtaaaagaaaaattaccgttaacagaaactgcggcagaaatagttttacagtttagatgtgaaatagagaaaatattagattttcaagatagacgcaaatttatagtagttgggccttgttctattcatgaccctaatgcagcattggaatacgcccataagttaaaaaaattagccgaacgcgtccaggataaactactgttaattatgcgggtttattttgaaaagccccgcacaactgtaggctggaaaggattaattaatgatccagaaatggatgattcttttctggtggaaaatggcttattactagccagagatttactcatcaagttaacagagttagggctacccaccgctacagaggctctagaccctattgtaccgcaatatattggtgaattgatcacatgggcggcgatcggcgcacgcacaacggaatcccaaactcacagggaaatggctagcggtctctctatgcctgtgggtttcaaaaatggcactgatggtaatattcaagtagctttaaatgctttacattctgccagaatgccgcataattttttgggcattaatcctgacggacaggtaagtgtatttgaaacgaaaggtaatgcctacggtcatgttattttgcgtggaggaaatcaacctaattttgattctgaaagtgttagacaagtagaagaaaaattaaagcaggctaaattacctccaagaattgtcattgattgtagtcatggtaatactaataaaaattacaggctacaatctgatgttttagaaaacgttgtgcaacagatagttgatggtaatacatcgattgtagggatgatgctggaatcaaatttatatgaagggaatcaacccattaactgcaaacgggaagaattgaaatatggggtttctgtaactgacccctgtatcggttgggagcaaacggaaaaaattatcttggctgcttacgaaaaacttaattga

SEQ ID NO: 1344 - protein, 376 aa, Anabaena variabilis ATCC 29413
MMNLCCTFHLQYVYPICLKSYPDNLEQSSMHNKLTNANIENYHVLLTPNEVKEKLPLTETAAEIVLQFRCEIEKILDFQDRRKFIVVGPCSIHDPNAALEYAHKLKKLAERVQDKLLLIMRVYFEKPRTTVGWKGLINDPEMDDSFLVENGLLLARDLLIKLTELGLPTATEALDPIVPQYIGELITWAAIGARTTESQTHREMASGLSMPVGFKNGTDGNIQVALNALHSARMPHNFLGINPDGQVSVFETKGNAYGHVILRGGNQPNFDSESVRQVEEKLKQAKLPPRIVIDCSHGNTNKNYRLQSDVLENVVQQIVDGNTSIVGMMLESNLYEGNQPINCKREELKYGVSVTDPCIGWEQTEKIILAAYEKLN

SEQ ID NO: 1345 - DNA, 1077 bp, Pseudomonas fluorescens PfO-1
  CDS (1)..(1077): transl_table=11
atggctgatttaccgatcaacgacctgaacgtcgcttccaacgagaccctgatcactcccgatcagctcaagcgtgatatccctctgagcgacgctgccctgcgcaccgtcacaaagggtcgcgaggtcatccgcaacattctcgatggcaccgaccatcgtctgttcgtggtgatcggcccctgctcgatccacgacatcaaggctgcccacgaatatgccgatcgcctgaaggtgctggcggcagaagtctcggacaccctgtatctggtcatgcgcgtgtatttcgagaaaccacggaccaccgtcggctggaaaggccttatcaacgacccgtacctggatgactcgttcaaaatccaggacggtctgcacatcggtcgccagttgctgctggacctggccgagaaaggcctgccgaccgcaaccgaagccctcgacccgatctccccgcagtatctgcaggacctgatcagctggtcggccatcggcgcccgtaccaccgaatcccagacccaccgcgagatggcttccggcctgtcttcggcggtcggcttcaagaacggcaccgacggcggcctgactgtggcgatcaacgccttgcagtcggtttccagcccgcaccgtttcctgggtatcaaccaggaaggtggcgtgtcgatcgtcaccaccaaaggcaacgcctacggtcatgtggtgctgcgcggcggcaacggcaagccgaactacgactcggtcagcgtcgccctgtgcgagcaggcgctgaacaaggcgaagatcaagccgaacatcatggtcgactgcagccacgccaactccaacaaggatccggccctgcaaccgttggtgatggagaacgtcgccaaccagatcctcgaaggcaaccagtcgatcatcggcctgatggtcgaaagtcacctgaactggggctgccaggcgatcccgaaagacctcgccgacctgcaatacggcgtgtcgatcaccgatgcgtgcatcgactggtccgctaccgaaaacaccttgcgcagcatgcacgccaagctcaaggatgtcctgccgaaacgtcagcgcggctga

SEQ ID NO: 1346 - protein, 358 aa, Pseudomonas fluorescens PfO-1
MADLPINDLNVASNETLITPDQLKRDIPLSDAALRTVTKGREVIRNILDGTDHRLFVVIGPCSIHDIKAAHEYADRLKVLAAEVSDTLYLVMRVYFEKPRTTVGWKGLINDPYLDDSFKIQDGLHIGRQLLLDLAEKGLPTATEALDPISPQYLQDLISWSAIGARTTESQTHREMASGLSSAVGFKNGTDGGLTVAINALQSVSSPHRFLGINQEGGVSIVTTKGNAYGHVVLRGGNGKPNYDSVSVALCEQALNKAKIKPNIMVDCSHANSNKDPALQPLVMENVANQILEGNQSIIGLMVESHLNWGCQAIPKDLADLQYGVSITDACIDWSATENTLRSMHAKLKDVLPKRQRG

SEQ ID NO: 1347 - DNA, 1074 bp, Burkholderia sp. 383
  CDS (1)..(1074): transl_table=11
atgcccccgcacaacaccgacgacgtccgcattcgcgaactcaaggaactgacgccgcccgcccacctgatccgcgaattcgcgtgctccgaagccgcgtccgagctgatctacaactcgcgccagtcgatgcaccgcatcctgcacgggatggacgaccggctgatcgtcgtggtcgggccgtgctcgatccatgacacgaaggcggcgatcgagtacgcgggccggctggtgaaggagcgcgagcgcttcaagggcgaactggaaatcgtgatgcgcgtgtacttcgagaagccacgcacgacggttggctggaagggcctcatcaacgatccgcacctcgacaacagcttcaagatcaacgaggggctgcgcaccgcgcgcgagttgctgctgcagatcaacgagatgggcctgccggccgcgaccgaatacctcgacatgatcagcccgcagtacatcgccgacctgatctcgtggggcgcgatcggcgcgcgtacgacggaatcgcaggtgcaccgcgagctcgcgtcggggctgtcgtgcccggtcggcttcaagaacggcaccgacggcaacgtgaagatcgcggtcgacgcgatcaaggccgcatcgcagccgcaccatttcctgtcggtgacgaagggcggccattcggcgatcgtgtcgacggccggcaacgaggactgccacgtgatcctgcgcggcggcaaggcaccgaactacgacgcggacagcgtgaacgccgcgtgcgcggacatcggcaaggccggcctcgccgcgcgcctgatgatcgacgcgagccacgcgaacagctcgaagaagcacgagaaccagatccccgtctgcgccgacatcggccgccagatcgcggccggcgacgcccgcatcgtcggcgtgatgatcgaatcgcatctcgtcgaggggcgccaggacctgaaggaaggctgcgagctgatctacggccagagcatcaccgatgcgtgcatcgcgtgggacgacagcgtgaaggtgctcgaaggcctcgcggaatcggtgaaggcgcgccgcgtcacacgcggcagcgggaactga

SEQ ID NO: 1348 - protein, 357 aa, Burkholderia sp. 383
MPPHNTDDVRIRELKELTPPAHLIREFACSEAASELIYNSRQSMHRILHGMDDRLIVVVGPCSIHDTKAAIEYAGRLVKERERFKGELEIVMRVYFEKPRTTVGWKGLINDPHLDNSFKINEGLRTARELLLQINEMGLPAATEYLDMISPQYIADLISWGAIGARTTESQVHRELASGLSCPVGFKNGTDGNVKIAVDAIKAASQPHHFLSVTKGGHSAIVSTAGNEDCHVILRGGKAPNYDADSVNAACADIGKAGLAARLMIDASHANSSKKHENQIPVCADIGRQIAAGDARIVGVMIESHLVEGRQDLKEGCELIYGQSITDACIAWDDSVKVLEGLAESVKARRVTRGSGN

SEQ ID NO: 1349 - DNA, 1131 bp, Burkholderia sp. 383
  CDS (1)..(1131): transl_table=11
atgcagaacctcgacaatccttcccacgatcgcgaggtaggcagcgccgacgcgacgcaggacaccacccgcatcgacgacgtccgcatcggcgccgtgcgcccgctgatttccccggcgctgctgctggacgaactgccggtgccggccgccacgcagacgctcgtcgaggatacgcgccgcgcgatcggcgacatcctgcacggccgcgacgaccggctgctgctcgtcgtcggcccctgctcgatccacgatcacgaccaggcactcgactacgcgcgccgcctgaaggtcgccgccgatgcgctgaaggacgacctgctgatcacgatgcgcgtctacttcgagaagccgcgtacgacggtcggctggaagggctacatcaacgatccgcgcctcgacggcagcttccgcatcaacgaagggctgcgcgccgcgcggcaattgctgctcgacatcaacgcgctgggcctgccggcgtcgaccgaattcctcgacctgctgagcccgcagtacatcgccgacctgatcgcgtggggcgcgatcggcgcgcgcacgaccgagagccagagccatcgccagctcgcgtcgggcctgagctgcccgatcggcttcaagaacggcaccgacggcggcgtgcaggtggcgtccgacgcgatcgtcgccgcggcggcgagccatgcgttcatggggatgacgaagatggggatggccgcgatcttcgagacgcgcggcaacgacgacgcgcacgtgatcctgcgcggcggcaagaacggcccgaactacgacgccgagcatgtcgaggcgagttgcgcggtgctgcgcaaggccggcttgcgcgagcaggtgatggtcgattgctcgcacgcgaactcgaacaagtcgcacgaccggcagatcgacgtcgcgcaggatctcgcgcggcaactgtcgcagggcgaacagcggatcgtcggcgtgatggtcgagagccatctcgaagccgggcgccaggacctgaagccgggtgtgccgctgaagtacggcgtatcgatcacggacgcatgcctgagctggacgcagacggaacccgttctcgacgtactggccgatgctgtgcggcaacggcgcgcacagtcgcgcaacgtgtga

SEQ ID NO: 1350 - protein, 376 aa, Burkholderia sp. 383
MQNLDNPSHDREVGSADATQDTTRIDDVRIGAVRPLISPALLLDELPVPAATQTLVEDTRRAIGDILHGRDDRLLLVVGPCSIHDHDQALDYARRLKVAADALKDDLLITMRVYFEKPRTTVGWKGYINDPRLDGSFRINEGLRAARQLLLDINALGLPASTEFLDLLSPQYIADLIAWGAIGARTTESQSHRQLASGLSCPIGFKNGTDGGVQVASDAIVAAAASHAFMGMTKMGMAAIFETRGNDDAHVILRGGKNGPNYDAEHVEASCAVLRKAGLREQVMVDCSHANSNKSHDRQIDVAQDLARQLSQGEQRIVGVMVESHLEAGRQDLKPGVPLKYGVSITDACLSWTQTEPVLDVLADAVRQRRAQSRNV

SEQ ID NO: 1351 - DNA, 1068 bp, Synechococcus sp. CC9605
  CDS (1)..(1068): transl_table=11
atggccaccacctccgatttgcatgtggtggagacacgtcccctggtggcccctgctgtgttgcatcaggaactgcccatggacgcggcggcgctcgagaccgtggcgtcagctcgccgacgcattcaagactttctcagtggccgtgatcagcgcttgctggtggtggtgggcccttgctctgttcacgacgtcaaagctgcccgggagtacgcccagcgcctggctccgatccgcgagcgcttgaaggatcagctcgaggtggtgatgcgggtgtatttcgagaagccgcgcaccacggttggttggaagggacttatcaatgacccccacctcgataactcctacgacatcaacaccggtctgcggcgagcccgaggactgctgttggatctcgcccgggaggggatgcctgctgcaacggaactgctcgatcccgtggttccccagtacatcgctgatttgatcagctggactgcgattggcgccaggacgacggaaagtcagacccaccgcgaaatggcctcagggctgtcgatgccgatcggctacaagaacagcaccaacggcagcgccaccatcgcgatcaatgccatgcaggcagcggggaagccacatcacttcctcggaatcaatcgcgatgggcatgcttcgatcgttagcaccacgggcaacccctacggccacctcgtgctgcggggcggcagccagggcagcaattaccacctggaggctgtgcaggaagccgcagccgagttgagccaggccggtctgcaggatcgactgatggtggattgcagccatgccaacagcaacaaagacttccgtcgacaggcagacgtgctggccagcgttgctgagcagttgcgagggggctccaaccacgtgatgggcgtgatgattgagagccatctggtggaaggcaaccagaagctcaacgccgacctgacgcagctgacctatggccagagcgtcacggatgcctgcatcagcctcgagaccaccgaaaccttgctggaggatctggccgcggccgtggccagtcgcaaacagacggtcaccgcatga

SEQ ID NO: 1352 - protein, 355 aa, Synechococcus sp. CC9605
MATTSDLHVVETRPLVAPAVLHQELPMDAAALETVASARRRIQDFLSGRDQRLLVVVGPCSVHDVKAAREYAQRLAPIRERLKDQLEVVMRVYFEKPRTTVGWKGLINDPHLDNSYDINTGLRRARGLLLDLAREGMPAATELLDPVVPQYIADLISWTAIGARTTESQTHREMASGLSMPIGYKNSTNGSATIAINAMQAAGKPHHFLGINRDGHASIVSTTGNPYGHLVLRGGSQGSNYHLEAVQEAAAELSQAGLQDRLMVDCSHANSNKDFRRQADVLASVAEQLRGGSNHVMGVMIESHLVEGNQKLNADLTQLTYGQSVTDACISLETTETLLEDLAAAVASRKQTVTA

SEQ ID NO: 1353 - DNA, 1068 bp, Geobacter metallireducens GS-15
  CDS (1)..(1068): transl_table=11
atgaccaagacaagcaacctgaaggtcacgagcattacccccatcatcgcccctgccgacctgcggcaagttttcccccaatcgctggaaacagctgaattcgttaatgcgagccgggcccacatcaagaacatcctcaaggggaaagacacccgcctcatggtggtggtgggcccctgttccattcacgaccccaaggccgccctcgactatgcggggcgccttgcgcgactcgccagcgaactctccgaccagcttttcatcgtgatgcgggtctacttcgagaagccccgcaccaccatcggctggaaggggctcatcaacgaccccgacatgaaccacacccaccagatctccaagggactcggcatcgcgcggcggctcctgaacgacatcaccagcatgctcctccccgtggcgtgcgagatgctcgataccatcacccctgaatacctggccgactatatctcgtggggcgccatcggcgcccggaccaccgagagccaatcgcaccgggagatggcgagcggcctttccttccccgtgggcttcaaaaatggcactgacggcaacctgcagatcgccatcgacgccatgaacgcggcgctccacccccacagcttcctcggcatcaatcgggatggcaagacctccatcatccagaccaccggcaacccggacgtgcacatcgtcctgcgtggcggcaagaagcccaactactctcccgaggacatcgccaagaccgaagagatggttgaaaaggggggtatcttcccgaccatcatggttgattgcagccacggcaactcggagaagcgccacgagaagcagccggaggtgcttgacagcatcgtcgaccagatcgaggcgggcaatcgctccatctcgggggtcatgatcgagagcttcctcgaagcggggaaccagcccattcccaaggatctgtcccaactccgctacggggtctccaccaccgacaagtgcatcgactggaagaccaccgaggaaatcctgcgcaaggcccatgaacggctcaagcgctgcggcggaagaccgatgcacggttga

SEQ ID NO: 1354 - protein, 355 aa, Geobacter metallireducens GS-15
MTKTSNLKVTSITPIIAPADLRQVFPQSLETAEFVNASRAHIKNILKGKDTRLMVVVGPCSIHDPKAALDYAGRLARLASELSDQLFIVMRVYFEKPRTTIGWKGLINDPDMNHTHQISKGLGIARRLLNDITSMLLPVACEMLDTITPEYLADYISWGAIGARTTESQSHREMASGLSFPVGFKNGTDGNLQIAIDAMNAALHPHSFLGINRDGKTSIIQTTGNPDVHIVLRGGKKPNYSPEDIAKTEEMVEKGGIFPTIMVDCSHGNSEKRHEKQPEVLDSIVDQIEAGNRSISGVMIESFLEAGNQPIPKDLSQLRYGVSTTDKCIDWKTTEEILRKAHERLKRCGGRPMHG

SEQ ID NO: 1355 - DNA, 1068 bp, Prochlorococcus marinus str. MIT 9312
  CDS (1)..(1068): transl_table=11
atgacgacatcatcaaataattctgctttagaaaagacatcagatttacatgttgttgaaacacgtccattaatacctccaagcagattacataatgatatacctttagatcacgcctctgctaatacagtatctaaaacaagaagatcgatacaaaatattttgcatcataatgatcagaagcttttagtcattgtgggtccatgttcaattcatgatttagaggcggcaaaagaatattcaaaatatattgaaaactttcgagaaatttataaagataaattagaaataatcatgagagtatattttgagaaaccaagaacaactattggttggaagggattgataaatgatcctcatctagataattcttatgatattaatactggattaagaagggcaagaagtttactttcatatttagcaactcgtggaattccttctgctacagaattactagatccaattgttcctcaatatattgccgatttaataagttggacagccataggcgcgcggactactgaaagtcagactcatcgggaaatggcatcaggattatcaatgcctataggttttaaaaatggtacagatggttcttttactactgcaataaatgcaatgcagtcagcttcaaaatctcatcattttttaggtgtaaatcaaaatggaatggcttctattgttaatacaacagggaatccagatggacatatagttttaagaggcggttcaaaaggcccaaattttgaaagtgaacatgttaaaagaatttcctctgaattgaagcaatctcatcttccccataaagtgatgattgattgtagtcatgggaattccaataaagatttccgaaaacagtcggaagtgctaaaaaatatagcttctcaaattagcaatggtgaaaaaaatattttaggagttatgcttgaaagtcatttgaaggagggaaatcaaaaacttttaaaaaaagaggatcttcagtttggcagaagcattacagatgcatgcatagatatagaaacaacaaaagaattactcgctattttgtacaattcacttagttag

SEQ ID NO: 1356 - protein, 355 aa, Prochlorococcus marinus str. MIT 9312
MTTSSNNSALEKTSDLHVVETRPLIPPSRLHNDIPLDHASANTVSKTRRSIQNILHHNDQKLLVIVGPCSIHDLEAAKEYSKYIENFREIYKDKLEIIMRVYFEKPRTTIGWKGLINDPHLDNSYDINTGLRRARSLLSYLATRGIPSATELLDPIVPQYIADLISWTAIGARTTESQTHREMASGLSMPIGFKNGTDGSFTTAINAMQSASKSHHFLGVNQNGMASIVNTTGNPDGHIVLRGGSKGPNFESEHVKRISSELKQSHLPHKVMIDCSHGNSNKDFRKQSEVLKNIASQISNGEKNILGVMLESHLKEGNQKLLKKEDLQFGRSITDACIDIETTKELLAILYNSLS

SEQ ID NO: 1357 - DNA, 1065 bp, Synechococcus elongatus PCC 7942
  CDS (1)..(1065): transl_table=11
atgaaacagacttccgatctccacgtcgtcgagacgcgttccttgatcagtcctgcggaaattcaccagaagctgcccctttccgagacagcagcagacttggtggcttctacccgcgatcgcgttcgtagcattttgcgcaatagcgatcgccgcctgttggtgattgtcgggccctgctccattcacgacgtcaacgcagcttacgactacggccaaaagctcttgccactgcgcgaagagctggcggatgaacttgaaatcgtgatgcgggtctactttgaaaagccccgcacgacggtcggctggaaaggattgatcaacgatccccacctcgacggcagctacgacatcaataccggcatccagcgggctcgcaagttattgctcggtttggcagatatgggcttgcccgccgcgacagaactgctcgacccgattattccgcagtacatcgctgatgtaattgcttggacggcgattggggcgcgaaccaccgaaagtcaaactcaccgcgaaatggcttcgggcctgtcgatgccgatcggcttcaaaaatggcaccgatggtagcttccatatcgcagccaatgccatgctttccgccagccagccccaccatttcctgggaattaaccatgacggtctggccagcattgtctcgaccaccggcaatccagacggtcatttagtgctgcgcggcggcagcaaaggtccaaattacgcagcagcggacattgaagaagcagcctatcaactggctagcatgggcctccatgcacgagtgatggtggactgcagccacggcaactccaacaaggactatcgccgtcagtcagtggtgctctcagatctggccgaacaggttgctgagggatcgcgtcacctgatgggcgtgatgattgaaagccacctggttgaaggcaatcaacccatcccagccgacttgtcagagttgcgctacggccaaagcatcaccgatccctgcgtcgactttccgaccacagagaaaatgctgcgggagctagcccgagcccagcgcggcttagtcccgtccttggcttaa

SEQ ID NO: 1358 - protein, 354 aa, Synechococcus elongatus PCC 7942
MKQTSDLHVVETRSLISPAEIHQKLPLSETAADLVASTRDRVRSILRNSDRRLLVIVGPCSIHDVNAAYDYGQKLLPLREELADELEIVMRVYFEKPRTTVGWKGLINDPHLDGSYDINTGIQRARKLLLGLADMGLPAATELLDPIIPQYIADVIAWTAIGARTTESQTHREMASGLSMPIGFKNGTDGSFHIAANAMLSASQPHHFLGINHDGLASIVSTTGNPDGHLVLRGGSKGPNYAAADIEEAAYQLASMGLHARVMVDCSHGNSNKDYRRQSVVLSDLAEQVAEGSRHLMGVMIESHLVEGNQPIPADLSELRYGQSITDPCVDFPTTEKMLRELARAQRGLVPSLA

SEQ ID NO: 1359 - DNA, 1119 bp, Burkholderia thailandensis E264
  CDS (1)..(1119): transl_table=11
atgcaaaacatcgacaacccgcagcgcgaccgggaagccggctgcgccgacgcgacgcaggacacgacgcgcatcgacgacgtgcgcatcggcgcggtgcgcccgctcatctcgccggcgctgctgcaggacgaactgcccgtgccgggcgccgtccagacgctcgtcgaagcgagccgcgacgcgatcggcggcgtgctgcacggccgcgacgatcgcctgctcgcgatcgtcggcccgtgctcgatccacgatcacgaccaggcgctcgactacgcgcgccggctgaaggccgccgccgacgcgctgcgcgacgacctgctgatcgtgatgcgcgtgtatttcgagaagccgcgcacgacggtcggctggaagggctacatcaacgatccgcgcctcgacggcagcttccgcatcaacgaagggctgcgcgccgcgcgccggctgctcatcgacatcaacgcgctcggcctgcccgccggcaccgaattcctcgatctgctgagcccgcagtacatcgcggacctgatcgcgtggggcgcgatcggcgcgcgcacgacggagagccagagtcaccggcagctcgcgtcggggctgagctgcccgatcggcttcaagaacggcaccgacggcggcgtgcaggtcgcggccgacgcgatcgtcgcggcgcgcgcgagccacgcgttcatgggcatgacgaagatgggaatggcggcgatcttcgagacgcgcggcaacgacaccgcgcacgtgatcctgcgcggcggcaagaagggcccgaactacgatcgcgcgagcatcgacgaagcgtgcgcggcgctgcgcgcggcggacctgcgcgaacaggtgatggtcgactgctcgcatgcgaattcgaacaagtcgcacctgcggcagatcgacgtcgccgaggacctcgcgcggcagttgtcggacggcgagcggcgcattaccggcgtgatggtcgagagcaacctggaggccggccggcaggatctgaagcccggcgcgccgctgcaatacggcgtgtcgatcaccgacgcatgcctgagctgggcgcagaccgagcccgtgctcgacacgctcgcgcaggcggtgcggcggcggcgcaccgcctga

SEQ ID NO: 1360 - protein, 372 aa, Burkholderia thailandensis E264
MQNIDNPQRDREAGCADATQDTTRIDDVRIGAVRPLISPALLQDELPVPGAVQTLVEASRDAIGGVLHGRDDRLLAIVGPCSIHDHDQALDYARRLKAAADALRDDLLIVMRVYFEKPRTTVGWKGYINDPRLDGSFRINEGLRAARRLLIDINALGLPAGTEFLDLLSPQYIADLIAWGAIGARTTESQSHRQLASGLSCPIGFKNGTDGGVQVAADAIVAARASHAFMGMTKMGMAAIFETRGNDTAHVILRGGKKGPNYDRASIDEACAALRAADLREQVMVDCSHANSNKSHLRQIDVAEDLARQLSDGERRITGVMVESNLEAGRQDLKPGAPLQYGVSITDACLSWAQTEPVLDTLAQAVRRRRTA

SEQ ID NO: 1361 - DNA, 1074 bp, Burkholderia thailandensis E264
  CDS (1)..(1074): transl_table=11
atgcccccgcacaataccgacgacgtccgcatccgagaactgaaggagctgactccgcccgcccacctgatccgcgaattcgcgctcggcgaggcggtgtcggagctcatctacaacgcgcgccaggcgatgcaccggattctgcacgggatggacgatcgcctgatcgtcatcatcggaccgtgctcgatccacgacacgaaggcggcgctcgaatacgcgggccggctcgtcaaggagcgcgagcgcttcgcgaacgagctcgagatcgtgatgcgcgtgtacttcgagaagccgcgcacgacggtcggctggaaggggctcatcaacgatccgcacctcgacaacagcttcaagatcaacgatggcctgcgcaccgcgcgcgagctgctgctgcagatcaacgagatggggctgcccgccggcaccgagtacctcgacatgatcagcccgcagtacatcgccgacctgatctcgtggggcgcgatcggcgcgcgcacgaccgaatcgcaggtgcatcgcgagctcgcgtcggggctgtcgtgcccggtcggcttcaagaacggcaccgacggcaacgtgaagatcgcggtcgacgcgatcaaggccgcgtcgcagccgcaccatttcctgtcggtgacgaagggcggccactcggcgatcgtgtcgacggccggcaacgaggactgccacgtgatcctgcgcggcggcaaggcgccgaactacgacgccgacagcgtgaacgccgcgtgcgcggacatcggcaaggcgggcctcgccgcgcgcctgatgatcgacgcgagccacgcgaacagctcgaagaagcacgagaaccagatccccgtgtgcgcggacatcggccgccagatcgcggcgggcgacgagcgcatcgtcggcgtgatggtcgagtcgcacctcgtcgaaggccgccaggacctgaaggaaggctgcccgctcacgtacgggcagagcattaccgacgcgtgcatcaactgggacgacagcgtgaaggtgctcgaagggctcgccgaagcggtgaaggcgcgccgcgtcgcgcgcggcagcggcaactga

SEQ ID NO: 1362 - protein, 357 aa, Burkholderia thailandensis E264
MPPHNTDDVRIRELKELTPPAHLIREFALGEAVSELIYNARQAMHRILHGMDDRLIVIIGPCSIHDTKAALEYAGRLVKERERFANELEIVMRVYFEKPRTTVGWKGLINDPHLDNSFKINDGLRTARELLLQINEMGLPAGTEYLDMISPQYIADLISWGAIGARTTESQVHRELASGLSCPVGFKNGTDGNVKIAVDAIKAASQPHHFLSVTKGGHSAIVSTAGNEDCHVILRGGKAPNYDADSVNAACADIGKAGLAARLMIDASHANSSKKHENQIPVCADIGRQIAAGDERIVGVMVESHLVEGRQDLKEGCPLTYGQSITDACINWDDSVKVLEGLAEAVKARRVARGSGN

SEQ ID NO: 1363 - DNA, 1386 bp, Syntrophus aciditrophicus SB
  CDS (1)..(1386): transl_table=11
gtggtgaaactggtagacgcaggggactcaaaatcccccgatccttgcggtcatgtgggttcgattcccacctccggcaccatttctgatcaatgttgcatctctccactcgattccaccggatttgtcgttcctcttcaaatttttaccaccaaaatccgaatatcattgttcacgaagatccctgaattgcgccgtttcgcaatccagaataaaaaccgcatttgccatcaatattttgattactattttgtgcaggaaagtgtagaaagaagaaaatatcagaagcgattcttttccagcaaccttgaaaaacgaacgatgatcaagaccaacaacctgaaaataaaacgaattacacctgtcattgccccgaaggacttgagacaggttttcccggtttccgatgcggcggggaagtttgttaccctgagtcgaatgcatatcaccaatattctaagggggcttgattcgcgcctcatggtggtcgtgggtccctgctccattcacgatccgaaggccgcactggaatatgccgaaagactttcccatctttccagacaactctccgaccggcttttcatcatcatgcgagtttattttgaaaaaccccgtaccaccatcggatggaaaggattgatcaacgatccggacatggacggcactcatcagatatcaaaaggccttggcattgcgaggagcctgctttgcgccattacggaaaaaaaactgcccatcgccacggagatgctcgaccccatcacccccgaatatctggccgacctgttgagctggggagcaatcggagcgcgcacaacggagtctcagcctcacagggaaatggccagcgggctttccttccccatcggtttcaaaaacgggacagacggcaacctgcagatcgccattgatgcgatcagatcggctctcgtttcccacagttttctcggcatcgacaaagatggaaaaaccgccattctccagacaacgggcaaccccgatctccacatcgttctccggggcagcgcgaaaaaaccgaattacatgcctgaggatatttccagaacggtggaattgatgaagcaggcacagctcccccccagcatcatggtggactgcagtcatggcaattcaggaaaggattacaaaaaacagccttctgtgatggatcagatttttaagcagatcgagtcgggtcagggaagcatctgcgggataatgattgaaagcaatctggaggaggggaatcaaccgattcccaagaacctctctctgatgaaatacggggtgtcgataaccgatccctgccttgactggcgaacgacggaggaaatgctccggtccgcccacgatcgattaagcgcctgcggcggcagaccaatatga

SEQ ID NO: 1364 - protein, 461 aa, Syntrophus aciditrophicus SB
MVKLVDAGDSKSPDPCGHVGSIPTSGTISDQCCISPLDSTGFVVPLQIFTTKIRISLFTKIPELRRFAIQNKNRICHQYFDYYFVQESVERRKYQKRFFSSNLEKRTMIKTNNLKIKRITPVIAPKDLRQVFPVSDAAGKFVTLSRMHITNILRGLDSRLMVVVGPCSIHDPKAALEYAERLSHLSRQLSDRLFIIMRVYFEKPRTTIGWKGLINDPDMDGTHQISKGLGIARSLLCAITEKKLPIATEMLDPITPEYLADLLSWGAIGARTTESQPHREMASGLSFPIGFKNGTDGNLQIAIDAIRSALVSHSFLGIDKDGKTAILQTTGNPDLHIVLRGSAKKPNYMPEDISRTVELMKQAQLPPSIMVDCSHGNSGKDYKKQPSVMDQIFKQIESGQGSICGIMIESNLEEGNQPIPKNLSLMKYGVSITDPCLDWRTTEEMLRSAHDRLSACGGRPI

SEQ ID NO: 1365 - DNA, 1062 bp, Saccharophagus degradans 2-40
  CDS (1)..(1062): transl_table=11
atgtcacacgtagaagacctgaacgtagtgtctcaggaagtgttaattacccccgctgagcttaagcaagaattacctatttctgctgctgcagcgaaaatggtcactgaagggcgcgaaactgtgcgcaatattcttgaccgtaaagatcaccgcttaatggttgttattggcccatgctcaatacacgatccaaaagctgctatcgactatgccaaccgcttgaaagcgttgtccgataaggtgcaagacactctctacattgttatgcgtgtgtattttgagaagccaagaacaactgtaggctggaaaggccttatcaacgacccttacatgaacgactccttcaaaattcaagatgggttgcatgtgggccgcaagttgttattagacatagccgagctgggcctacccacggccaccgaagcgctagaccctatttcgcctcaatacctgcaagatttaatttcttggagcgctattggcgcacgtactaccgagtcgcaaacacacagagaaatggcgagcggcctctcctctgccgtaggctttaaaaacggtactgacggcggtttaacggttgctattaacgcattgcagtcagtttctagcccgcaccgttttttaggtattagcaaagacggctctgttgcggttatgcatacccgtggcaacgagtacggccatgttgtattgcgcggtggtaacggcaagcccaactacgattcagttagcgtagctatttgcgaaaaagagttagagaaagccaaggttccggtaaacatcatgatcgactgcagccacgctaactctaataaaaaccacgagctacagccgctggtaatggaaaatgtgagcaatcaaattattgaaggcaacaaatcgattataggcgtgatgattgaaagtaatattggtgctggcaaccagagcatccctgataatctcgatgatttggcctacggtgtgtctgttaccgatgcctgtattgattggcaatcgacggaagatttactgcttagcactgcaagtaaattacgagaagttttacccaagcgctaa

SEQ ID NO: 1366 - protein, 353 aa, Saccharophagus degradans 2-40
MSHVEDLNVVSQEVLITPAELKQELPISAAAAKMVTEGRETVRNILDRKDHRLMVVIGPCSIHDPKAAIDYANRLKALSDKVQDTLYIVMRVYFEKPRTTVGWKGLINDPYMNDSFKIQDGLHVGRKLLLDIAELGLPTATEALDPISPQYLQDLISWSAIGARTTESQTHREMASGLSSAVGFKNGTDGGLTVAINALQSVSSPHRFLGISKDGSVAVMHTRGNEYGHVVLRGGNGKPNYDSVSVAICEKELEKAKVPVNIMIDCSHANSNKNHELQPLVMENVSNQIIEGNKSIIGVMIESNIGAGNQSIPDNLDDLAYGVSVTDACIDWQSTEDLLLSTASKLREVLPKR

SEQ ID NO: 1367 - DNA, 1083 bp, Methylobacillus flagellatus KT
  CDS (1)..(1083): transl_table=11
atgagcccataccagaaaattgcgactgacgatgttcgcatcaaggaaatcaaggagctgagattaccgtccgagctgcttgaggagctgcctgccagtcccgccatcacggacaacatcttggctacccgcagcgccattcataaaatcttgcacagcgccgacgacaggctgctcgttgtcattggcccctgctccatccatgactatgatgccgggctggaatatgcccgccgcctggtggcgctgcgccctcgcttcgaacaagagctgctgctcgtgatgcgagtctattttgagaaaccacgtaccaccgtgggctggaaaggcctgatcaacgatcctttcctcgacggcagctaccgcattaacgaaggcctggagctggcgcgccgcttcctgctggacgtcaatgccctcggcatgcctgccggcaccgaattccttgacgtcatcacgccgcaatatactgccgacctggtgagctggggggcaatcggcgcacgcacgacagaatcgcagatccaccgtgagctggcgtctggtctctcctgccccgttgggttcaagaacggcacggatggcaatatccgcattgctgtcgacgccatcaaggcagcagccagcccgcaccactttctatccgtgaccaaggaaggccgttccgccatcatctccaccagcggcaacgaagattgccacgtcatcctgcgcggcggcaaaactcccaactacgatgccgccagtgtcgaggatgccgcacgcgaacttgccaatgcaggacttgccgccaaggtgatgatcgactgctcgcatgccaacagcctcaagcaattcaaacgccaaatcgatgtcgtcgccgatgtcaccagtcagatctccagcggtgacgaccgcatcatcggcacgatgatcgagtcgcacctcaatgaaggtcgacaggacctggtaccgggttgccagctggagtatggcaagtcgatcaccgacggctgcctgggttgggatgactcggtcaccctattggatacactggcggaaagcgtacggaagcgccgcaagcttcaggaagaagccgaataa

SEQ ID NO: 1368 - protein, 360 aa, Methylobacillus flagellatus KT
MSPYQKIATDDVRIKEIKELRLPSELLEELPASPAITDNILATRSAIHKILHSADDRLLVVIGPCSIHDYDAGLEYARRLVALRPRFEQELLLVMRVYFEKPRTTVGWKGLINDPFLDGSYRINEGLELARRFLLDVNALGMPAGTEFLDVITPQYTADLVSWGAIGARTTESQIHRELASGLSCPVGFKNGTDGNIRIAVDAIKAAASPHHFLSVTKEGRSAIISTSGNEDCHVILRGGKTPNYDAASVEDAARELANAGLAAKVMIDCSHANSLKQFKRQIDVVADVTSQISSGDDRIIGTMIESHLNEGRQDLVPGCQLEYGKSITDGCLGWDDSVTLLDTLAESVRKRRKLQEEAE

SEQ ID NO: 1369 - DNA, 1119 bp, Burkholderia xenovorans LB400
  CDS (1)..(1119): transl_table=11
ttgaacgccatcgacaatcctttgcacgatcaggaagtcggctcggccgacgccacccaggacaccacgcgcatcgacgacgttcggatcggcgcggtacgtccgctgatttcccctgcgctgttgcaggacgagttgcccacaccgccttcggtgcagacgctggtcgagaagacccgcgcggaaatcgccgacattctgcatggccgcgacgaccggctcgtgatgatcgtcggaccgtgctcgattcacgaccacgaccaggcgatcgactatgcgcgcaagctgaaagtcgccgccgacacttacagggacgacctgctgatcgtaatgcgggtctacttcgagaagccgcgcactaccgtcggctggaaaggctatatcaacgacccgcggctcgacggcagtttccgtatcaatgaaggtctgcgtctcgctcggcaattgctgctcgatatcaacggtctcggcctgtccaccgccaccgagtttctcgacctgctgagcccgcagtacatcgccgatctgatcgcgtggggcgctatcggcgcgcgcacgacggagagtcagagccatcgtcaactcgcttcgggactgagctgcccgatcggcttcaagaacggcacggacggcggcgtgcagatcgccgcggacgcgatcgtcgccgcgcgcgcgagccatgcgttcatgggcatgacgaaaatgggcatggccgcgatcttcgaaacgcgcggcaacgacgacgcgcacgtgatcctgcgcggcggcaagaaagggcctaactacgacagcgcgtcggtggacgcgacttgcgtcgcgctgaaatcagcgggactgcgcgagcaggtcatgatcgactgttcgcatgcgaactcgggcaaatcgcatttgcgtcaactcgaagtggtgcaggatatcgcgctgcagttgtcgcagcgcgagcgccgcattatcggcgtcatgctggaaagtcatctggaagaaggccgccaggatctgaagcctggtgtgccgttgcgtcacggcgtatcgatcacggatgcctgcgtcagctgggcgcagaccgagccggtgctcgaaacactcgccgaggccacccgcaaacgccgcgcgggctaa

SEQ ID NO: 1370 - protein, 372 aa, Burkholderia xenovorans LB400
MNAIDNPLHDQEVGSADATQDTTRIDDVRIGAVRPLISPALLQDELPTPPSVQTLVEKTRAEIADILHGRDDRLVMIVGPCSIHDHDQAIDYARKLKVAADTYRDDLLIVMRVYFEKPRTTVGWKGYINDPRLDGSFRINEGLRLARQLLLDINGLGLSTATEFLDLLSPQYIADLIAWGAIGARTTESQSHRQLASGLSCPIGFKNGTDGGVQIAADAIVAARASHAFMGMTKMGMAAIFETRGNDDAHVILRGGKKGPNYDSASVDATCVALKSAGLREQVMIDCSHANSGKSHLRQLEVVQDIALQLSQRERRIIGVMLESHLEEGRQDLKPGVPLRHGVSITDACVSWAQTEPVLETLAEATRKRRAG

SEQ ID NO: 1371 - DNA, 1074 bp, Burkholderia xenovorans LB400
  CDS (1)..(1074): transl_table=11
atgcccccgcacaacaccgacgatgtccgcatccgcgaattgaaagaactcacgccgcccgctcacctgatccgtgaattcgcctgcgacgaaacggtgtccgacgtgatctataactcgcgcacctcgatgcatcgcattctgcacggcatggaagatcgcctgatcgtgatcatcggaccgtgctcgattcacgatacgaaggcggcgatggaatacgccggccgtctggtcgagcagcgcaagcgctttgccggcgagctcgaaatcgtgatgcgcgtgtacttcgaaaagccgcgcacaactgttggctggaagggtctcatcaacgacccgtacatggacaatagcttcaagatcaacgaaggcctgcgcaccgcgcgcgagttgctgttgcgcatcaacgaactcggcctgccggccggcaccgaatacctcgacatgatcagtccgcagtacatcgccgacctgatctcgtggggcgcaatcggcgcgcggaccaccgaatcgcaggtgcaccgcgaactggcttcgggcctgtcgtgcccggtcggcttcaagaacggcacggacggcaacgtcaagatcgcggtcgacgcgatcaaggccgcctcgcagccgcaccatttcctgtcggtcacgaagggcggccactcggcaatcgtgtcgaccgcgggcaatgaggactgccacatcatcctgcgcggcggcaagacgccgaactacgacgcggacagcgtcaacgccgcgtgcgcggacatcggcaaggccggtctcgccgcgcgcctgatgatcgacgcgagccacgcgaacagctcgaagaagcacgagaatcagattccggtgtgcgcggatatcggccgccagattgcttcgggtgacgaacggattgtcggcgtgatggtggaatcgaatctggtggcgggccgccaggatctgcaggaaggctgcgcgctgacgtacggccagagcatcaccgacgcgtgcatcggctgggacgaaagtgtcgccgtgctggaaggcctcgccgacgcggtgaagcagcgccgtgtggcacgcggcagcggcaactga

SEQ ID NO: 1372 - protein, 357 aa, Burkholderia xenovorans LB400
MPPHNTDDVRIRELKELTPPAHLIREFACDETVSDVIYNSRTSMHRILHGMEDRLIVIIGPCSIHDTKAAMEYAGRLVEQRKRFAGELEIVMRVYFEKPRTTVGWKGLINDPYMDNSFKINEGLRTARELLLRINELGLPAGTEYLDMISPQYIADLISWGAIGARTTESQVHRELASGLSCPVGFKNGTDGNVKIAVDAIKAASQPHHFLSVTKGGHSAIVSTAGNEDCHIILRGGKTPNYDADSVNAACADIGKAGLAARLMIDASHANSSKKHENQIPVCADIGRQIASGDERIVGVMVESNLVAGRQDLQEGCALTYGQSITDACIGWDESVAVLEGLADAVKQRRVARGSGN

SEQ ID NO: 1373 - DNA, 1080 bp, Ralstonia metallidurans CH34
  CDS (1)..(1080): transl_table=11
atgctgaagaacaccgacgacctgcgtattcgagaactcaaggaactgctgccgcccgcgcacctgatccgcgagtttgcttgctcggaggctgcgtccgacgtgatctatggcgcccgccaggccatgcatcgcattctgcacggcatggacgaccgcctgatcgtcatcatcggcccgtgctcgattcacgacacgcgcgcggccctggaatacgccaagctgctcaaggtgcagcgcgaccgcttcgcgggcgagctcgagatcgtgatgcgcgtctacttcgagaagccgcgcacgacggtgggctggaagggcctgatcaacgatccgcacatggatggcagcttcaagatcaacgacggcctgcgcaccgcccgcgaactgctgctgaatatcagcgaaatgggcgtgccgacggggacggaatatctggacatgatcagcccccagtacatcgccgatctggtgagctggggcgcgatcggcgcgcgcaccaccgagtcgcaggtgcatcgcgaactcgcttccggactgtcgtgcccggtcggcttcaagaacggcaccgacggcaacgtgaagatcgccgtcgacgcgatcaaggccgcctcgcagccccaccatttcctgtcggtaaccaagggcggccactcggccatcgtgtcgacctcgggtaacgaggactgccacatcatcctgcgcggcggcaagacaccgaactacgacgcggccagcgtgcaggaagcctgcgacgcgatctcgaagtccggcctggccgcacgcctgatgatcgacgcctcgcacgccaacagcagcaagaagcacgagaaccagatcccggtctgcgaggacattggcaagcagatcgccggcggcgagcagcgcatcgtcggcgtcatggtggaatcgcacctggtagccggccgacaggaccatgtgcagggcactccggtggagaacctgacctacggccagtcggtgaccgacgcctgcatcgcctgggatgactccgtggccgtactggagacgctggccaacgccgtgaagcagcgccgtctggtgaccggcagcggcaactga

SEQ ID NO: 1374 - protein, 359 aa, Ralstonia metallidurans CH34
MLKNTDDLRIRELKELLPPAHLIREFACSEAASDVIYGARQAMHRILHGMDDRLIVIIGPCSIHDTRAALEYAKLLKVQRDRFAGELEIVMRVYFEKPRTTVGWKGLINDPHMDGSFKINDGLRTARELLLNISEMGVPTGTEYLDMISPQYIADLVSWGAIGARTTESQVHRELASGLSCPVGFKNGTDGNVKIAVDAIKAASQPHHFLSVTKGGHSAIVSTSGNEDCHIILRGGKTPNYDAASVQEACDAISKSGLAARLMIDASHANSSKKHENQIPVCEDIGKQIAGGEQRIVGVMVESHLVAGRQDHVQGTPVENLTYGQSVTDACIAWDDSVAVLETLANAVKQRRLVTGSGN

SEQ ID NO: 1375 - DNA, 1143 bp, Ralstonia metallidurans CH34
  CDS (1)..(1143): transl_table=11
atgaatgatccacaaaagtccccgcccagcgttgccgaaggctggcaggcgccgccggaccgcaccagtgtgacggacgatgcgcgcgtggaggacatcatcccgctgcccccgcccgagcacttgatccgtttcttccccatccgtggcacccccgttgaatcgctggtcacccagacgcgccagcgcatctcccgcattctgcatggcagtgatgaccggctgctcgtgatcatgggcccctgctcgatccacgacccgcaggccgcgctcgactacgcacggcgtctggcggccgaacgcgagcgctacgcggactcgctggaaatcgtgatgcgggtgtatttcgagaagccccgcaccacggtcggctggaagggcctgatcaacgacccctacctggacgagagctatcgcatcgacgaaggcctgcgcatcgcgcgcagcctgctggtggatatcaaccgcctcgggttgccggcggccggcgagttcctggacgtcatttcgccccagtacatcggcgatctgatctgctggggcgcgattggcgcccgcacgaccgagagccaggtacaccgggaactggcttcgggcgtctccgcgcccattggcttcaagaatggcaccgacggaaacatcaagatcgcgatcgacgcgatccaggccgcatcgcgcccgcaccacttccttggcgtgcacaagaacggccaggtcgcgacggtccataccaagggcaacccggactgccacgtcattcttcgcggcggcaaggcgcccaactacgacgcggaggttgtcgccgcagcgtgcaaggaactggaagcggcgcggctgcgcaattcgttgatggtcgattgcagccatgccaacagcaacaagcagcaccaacgccagatcgacgtcgcacgcgacgtggcgcagcagatcagcggcggcagccagtcgatcttcggcctgatggtcgagagccatctggtacccggcgcgcagaagttcaccccaggagaacacaacccatcgggtctcacttatggtcagagcatcacggacgcctgcatcgggtgggaggactccgtgacggtgctggaactgctgagcgaggcggtaaatgtacggcgtggggtaaacaggaaggcttaa

SEQ ID NO: 1376 - protein, 380 aa, Ralstonia metallidurans CH34
MNDPQKSPPSVAEGWQAPPDRTSVTDDARVEDIIPLPPPEHLIRFFPIRGTPVESLVTQTRQRISRILHGSDDRLLVIMGPCSIHDPQAALDYARRLAAERERYADSLEIVMRVYFEKPRTTVGWKGLINDPYLDESYRIDEGLRIARSLLVDINRLGLPAAGEFLDVISPQYIGDLICWGAIGARTTESQVHRELASGVSAPIGFKNGTDGNIKIAIDAIQAASRPHHFLGVHKNGQVATVHTKGNPDCHVILRGGKAPNYDAEVVAAACKELEAARLRNSLMVDCSHANSNKQHQRQIDVARDVAQQISGGSQSIFGLMVESHLVPGAQKFTPGEHNPSGLTYGQSITDACIGWEDSVTVLELLSEAVNVRRGVNRKA

SEQ ID NO: 1377 - DNA, 1095 bp, Silicibacter sp. TM1040
  CDS (1)..(1095): transl_table=11
atgaccaccctctctcagacaccgacccatgatctgcgcatcaccgacatgcaggaattgatctgccccgaagccctcgcggtgaaacacccgctgacagatgccgcgcgcgaaaccgtgctctcggcgcgcgccagcatccagaagatcctgcatggcgccgacgaccggctggtcgtcgtggtcggcccctgttcgatccacgacccggaggccgcgctggactatgcgcgccgtcttgcgccgctgcgcgccgagctgggcgatgcgcttgagatcgtgatgcgggtctactttgaaaaaccgcgcaccatcgcgggctggaaggggctgatcaacgaccccaaccttgatgggtctttccgcatcaacaaggggttgtcggtcgcccgcaagctctgcctggatctgagcgaaatgggcctgcccgtggggaccgaattcctcgatgcctcggtgccgcaatacatcagtgatctggtgagctgggccgcgattggcgcccgcaccaccgagagccagatccaccgcgaaatggcttcgggcctgagctgcccggtgggcttcaagaacggcacccgcggcaatgtgcagatcgccattgacgcggtgcgctcggcggccacaccgcatcatttcatggcgctggccccctcgggtctcgcggcgattgcggcgacggccggaaacccggattgccacatcatcctgcgcggcggcggtggtaccaactttgatgccgagagcgtggattcagcctgcaaaaaggccgaagccgatggcatccgtccgcaggtgatgatcgacgcaagccacgccaactctgccaaggatcccgccaaacagcccgaggtgctctcggatgtggccggccagatggcacagggtgagacccgcatcaccggcatcatgatcgaaagccacctcgaacagggtcgtcaggatctgcccaaggacggggacctgtcgaaactcacctatggtcagtcgatcaccgacggctgcatcggctgggagcaaaccgaggccgagctgcgcaaactggcccaggcggtcaaaacacgccgcacgcagggcgcccgcctggcgggttga

SEQ ID NO: 1378 - protein, 364 aa, Silicibacter sp. TM1040
MTTLSQTPTHDLRITDMQELICPEALAVKHPLTDAARETVLSARASIQKILHGADDRLVVVVGPCSIHDPEAALDYARRLAPLRAELGDALEIVMRVYFEKPRTIAGWKGLINDPNLDGSFRINKGLSVARKLCLDLSEMGLPVGTEFLDASVPQYISDLVSWAAIGARTTESQIHREMASGLSCPVGFKNGTRGNVQIAIDAVRSAATPHHFMALAPSGLAAIAATAGNPDCHIILRGGGGTNFDAESVDSACKKAEADGIRPQVMIDASHANSAKDPAKQPEVLSDVAGQMAQGETRITGIMIESHLEQGRQDLPKDGDLSKLTYGQSITDGCIGWEQTEAELRKLAQAVKTRRTQGARLAG

SEQ ID NO: 1379 - DNA, 1053 bp, Mycobacterium sp. MCS
  CDS (1)..(1053): transl_table=11
atgaacctggcgcagatcgccaccccgccggccacctccgaccggcgcatccgcagcttcagcgcgattcccagcccgcacgaggtgctcgcggagttcccgctgggtgcccggcgcgccgagcgggtggcccgcgaccgcaccgagatcgccgacatcctcgccggccgcgacgaccgactgctggtcgtggtcggtccgtgctcggtgcacgatccggtcgccgcgctgaactacgcaagccggctcgcgaagatcgccgacgaactcggcgaccggctcaagatcgtcatgcgcgtgtacttcgagaagccgcggacgacgatcggatggaaggggctgatcaacgatccggggatggacggcacgttcgatgtgtcgcgcggtctgcgcaccgcccgccagctgctgctcgacatcatcgacatcggcctacccgtcggatgcgagttcctggaaccgaccagcccgcagtacatcgccgacgccgtcgcctggggtgccatcggcgcccgcacgaccgaatcgcaggtgcaccgccaactcgcgtcgggtctgtcgatgcccgtcggcttcaagaacggcaccgacggcaacatccaggtggccgtcgacggggtgaaggccgccgcggcccagcacgtcttcttcgggatggacgactccggccgtggcgcagtcgtgagcaccgagggcaacgaggactgccacgtcatcctgcgcggcggtaccgacggacccaactaccacgcggatgccgtgcaggccgccgccgccaagctgaccgccgccggactgccgggacgggtcgtcgtcgactgcagccacgccaactccggcaaggaccacatccgccaggcggcggtggccgccgaggtggcccagctgatccgcgacgggcttccggtcagcggggtgatgctggagagcttcctggtcgggggtgcgcagtccgccgagtcgcggccgctcacttacgggcaatcggtcaccgacaaatgcatggactggaccgcgacggatctggtgctgcgagaactggcggcgcgctag

SEQ ID NO: 1380 - protein, 350 aa, Mycobacterium sp. MCS
MNLAQIATPPATSDRRIRSFSAIPSPHEVLAEFPLGARRAERVARDRTEIADILAGRDDRLLVVVGPCSVHDPVAALNYASRLAKIADELGDRLKIVMRVYFEKPRTTIGWKGLINDPGMDGTFDVSRGLRTARQLLLDIIDIGLPVGCEFLEPTSPQYIADAVAWGAIGARTTESQVHRQLASGLSMPVGFKNGTDGNIQVAVDGVKAAAAQHVFFGMDDSGRGAVVSTEGNEDCHVILRGGTDGPNYHADAVQAAAAKLTAAGLPGRVVVDCSHANSGKDHIRQAAVAAEVAQLIRDGLPVSGVMLESFLVGGAQSAESRPLTYGQSVTDKCMDWTATDLVLRELAAR

SEQ ID NO: 1381 - DNA, 1062 bp, Rubrobacter xylanophilus DSM 9941
  CDS (1)..(1062): transl_table=11
gtgagaaccagtgatctgcgcgtagagagcatccgacccctgatcccgcccgccatcctcctggaggagctccccctctcggaggacggggccctcacggtgagccgggcgcgggaggagatagtgcgcatcctcgagggcgaggacgaccgcctcatcgccgtggtcggcccctgctcggtgcacgacacctcggcggcgctggagtacgcccggcggctgcgggggctcgcggaggagctgcgcggggagctctgcgtgatcatgcgggtgtacttcgagaagccccggaccacggtcgggtggaaggggctcatcaacgacccgcacctggacgggagcttcgccgtgaacgaggggctcaggatggcgcgcggcctgctgctcgacgtggcggagctgggattgcccgccggctgcgagtttctggaccccatctcgccgcagtacttcaccgacgcggtggcctgggcggccatcggggcgcgcaccaccgagagccaggtgcaccggcagctggcctccggcctctccatgccggtgggcttcaagaacggcaccggcggcggggtgcagatagcggtggacgcggtgcgcgccgccgcccacccgcacagcttccccggggtgacccggcaggggctcgcggcggtcgtcaccaccaccggcaacccggactgccacgtcatcctgcgcggcggcaggagcggcccgaactacgacgagcggagcgtcggggaggccctggaggcgctgcgccgggccggcctcccgccccgcctgatggtggacgccagccacgccaacagcggcaaggactaccgccggcagccgctcgtgatccgggacgtggccgaccaggtcgcccggggccagagggggatcgtgggcgtgatgctggagagcttcctggtcgaggggagccaggagctcacggaccgctcccggctgacctacggccagagcatcaccgactcctgcatgggctgggagatgacggtccccaccctgcgcgagctggccgaggcggtcagggcccggcgcaccgtccgcgtcggctga

SEQ ID NO: 1382 - protein, 353 aa, Rubrobacter xylanophilus DSM 9941
MRTSDLRVESIRPLIPPAILLEELPLSEDGALTVSRAREEIVRILEGEDDRLIAVVGPCSVHDTSAALEYARRLRGLAEELRGELCVIMRVYFEKPRTTVGWKGLINDPHLDGSFAVNEGLRMARGLLLDVAELGLPAGCEFLDPISPQYFTDAVAWAAIGARTTESQVHRQLASGLSMPVGFKNGTGGGVQIAVDAVRAAAHPHSFPGVTRQGLAAVVTTTGNPDCHVILRGGRSGPNYDERSVGEALEALRRAGLPPRLMVDASHANSGKDYRRQPLVIRDVADQVARGQRGIVGVMLESFLVEGSQELTDRSRLTYGQSITDSCMGWEMTVPTLRELAEAVRARRTVRVG

SEQ ID NO: 1383 - DNA, 1089 bp, Rhodococcus sp. RHA1
  CDS (1)..(1089): transl_table=11
atgactgtcactctcgacaccactaccagcagtgaccggctggacgaccagcgcaccgccagcatcagcccgctggtggccccgtcggttgtgcgccgcgaatacgcccccgacgacgtcgcgtccgcgaccgtccgctccggccgcgccgacacggtgaacgtgctgaacggcgaggacgatcgactgctcgtcgtggtgggcccgtgctcggtgcacgacccggacgccgccatggactacgcccgccggctcgccgcgaaggccgaggaattgcgcgacgacctgcacatcgtgatgcgggtctacttcgagaagccgcgcaccacgctcggctggaagggtctgctcaacgacccgcacctggacggcacgttcgacatcgacaccgggatccgcatgggccgcaagctgctgctcgacgtgtcctcgctcggcctgccggtcggctgtgagttcctcgacccgatcatgccgcagtacatcgcggacctcgtcacgtacggcgcgatcggtgcccgcaccgccgccagccaggtgcaccggcagctgtgcagcgcgctgtcgatgccggtcggaatcaagaactcgacggaaggtgacgtgcaggtggcggtcgacggcacccgcgccgccgcggcgagccacgtgttccccggcaccgacctcgacgggcaggccgcgctgatccgcacggtcggcaaccccgactgccacgtcatcctccgcggcggcagcgacggaccgaactacgacgcggagacggtggcggacacgctcgcccggctgcgcaagggcggtctgccggagcgagtcgtcatcgacgccagccacggcaacagcagcaagaaccacgagaagcaggtcgacgtgctgaacgacatcgcggcccggctcgaggacggcgagaaggggatcgtcggtgtgatggtggaaagcttcatcgaagccggtcgtcaggacctcaccctcggaaaggccgaggacctcacgtacggccagtccatcaccgacgcgtgcatcgactggaacacgacggcatcgcagctggaccgtctcgcccaggcagtcgccgcgcgccggaagtga

SEQ ID NO: 1384 - protein, 362 aa, Rhodococcus sp. RHA1
MTVTLDTTTSSDRLDDQRTASISPLVAPSVVRREYAPDDVASATVRSGRADTVNVLNGEDDRLLVVVGPCSVHDPDAAMDYARRLAAKAEELRDDLHIVMRVYFEKPRTTLGWKGLLNDPHLDGTFDIDTGIRMGRKLLLDVSSLGLPVGCEFLDPIMPQYIADLVTYGAIGARTAASQVHRQLCSALSMPVGIKNSTEGDVQVAVDGTRAAAASHVFPGTDLDGQAALIRTVGNPDCHVILRGGSDGPNYDAETVADTLARLRKGGLPERVVIDASHGNSSKNHEKQVDVLNDIAARLEDGEKGIVGVMVESFIEAGRQDLTLGKAEDLTYGQSITDACIDWNTTASQLDRLAQAVAARRK

SEQ ID NO: 1385 - DNA, 1080 bp, Haemophilus somnus 129PT
  CDS (1)..(1080): transl_table=11
atggctaagaataaaaataatattcgtattgcaaatgatgacaccagaattgcaaaagttgagcaagttttgcccccgattgcattattagaaaaatttcctgcaagtgatgtagccattaaaacagtaaaaaaagcccgcttggcagcacataacattattcatcaaaaagatgatcgtttactcgttattattggaccttgttctattcatgatcctgcttctgcgttggaatatgctaaacgcattaaagaaatgcgtataaaatatcatgatacgttggaaattataatgcgtgtgtattttgaaaaaccacgtacaactgtgggttggaaaggattagtgaatgatcctcatttagatggtagttatgctttaaatgatggtttgcgtattgcacgtaaattgttatctgatattaacgatatggaaatgcctactgccggtgaatttttagatatgatttcaccgcaataccttgcggactttatgagttggggggctattggagcaagaacaacggaatcgcaagttcatcgtgaattggcatccggtttgtcatgtgcggtgggctttaagaatggaactaacggtggagttcgcattgctcttgatgcaataggtacggcagaagcaccacattattttctatctgtcacaaaattcggtcattcagcaattgtgtctacaaaaggaaatgaggattgtcatattattttgcgtggaggtgagaaaggtcctaattatagtgcggaagatgttcggacagtttgtgcggatatagaaaaaaccggtcgcattccgcatgttatggtggattttagtcatgcgaacagtagtaaacaatttaaaaaacagttagatgtttgcactgatgtctgtactcaaattgccaatggttcaaaacaaatttttggtgtcatggttgaaagccatttagtcgaaggtcgtcaagatttagttgaagcaaaagcacttacctatggacaaagtattaccgatgcttgtattggttggtcagatacagaaatcgtattacaacaattgtctgaggcattaattgaacgacgtaagaagtaa

SEQ ID NO: 1386 - protein, 359 aa, Haemophilus somnus 129PT
MAKNKNNIRIANDDTRIAKVEQVLPPIALLEKFPASDVAIKTVKKARLAAHNIIHQKDDRLLVIIGPCSIHDPASALEYAKRIKEMRIKYHDTLEIIMRVYFEKPRTTVGWKGLVNDPHLDGSYALNDGLRIARKLLSDINDMEMPTAGEFLDMISPQYLADFMSWGAIGARTTESQVHRELASGLSCAVGFKNGTNGGVRIALDAIGTAEAPHYFLSVTKFGHSAIVSTKGNEDCHIILRGGEKGPNYSAEDVRTVCADIEKTGRIPHVMVDFSHANSSKQFKKQLDVCTDVCTQIANGSKQIFGVMVESHLVEGRQDLVEAKALTYGQSITDACIGWSDTEIVLQQLSEALIERRKK

SEQ ID NO: 1387 - DNA, 1059 bp, Synechococcus sp. CC9311
  CDS (1)..(1059): transl_table=11
atgaccaccacccacgatctccatgtggtggacacgcgaccactgatccctcccgctctgttgcatcgcgatctgccaattgatccaacggctttagagacagtggtgacggctcgcagccgcattcaagccatcttgcgtggattagaccgccgactgctggtgattgttggtccttgttctgtgcacgatgtggaggctgctcgcgactacgcccgtcgtttggcgcctctgcgtgagcgtcatgcagccgagctggagattgtgatgcgggtgtatttcgaaaaaccccgtaccactgttggatggaaggggttgattaacgatccccatctcgatggctcttacgacatcaatacagggctacggatggcccgctccctgttgcttgatttggctcgagaaggaatgcccacagcgactgagttattggatcctgtagtccctcagtacatcgcggatctaatcagctggacagcgattggtgcacgcaccactgaaagccagacccatcgtgaaatggcttcaggcttatcgatgcccattggctacaagaacagcaccgatggcagcgccacgattgccattaatgcaatgcaggctgcagccaagcctcatcatttcttgggtatcaatcgtgagggccatgcttcgatcgtcagtacctctggaaacccaaatgggcacttggttttgcgtggtggcaatcgtggaaccaactaccacctggaagcgattcaggattcagctgccgaactgacgggtgccggtctcccggatcgcttgatggtggactgcagccatgccaattccagtaaagactttcgccgtcagagcgaggttttacaggcagttgcctctcaggtcgatcagaagtcagaccatgtgatgggagtcatgcttgaaagccacctcgtggaaggcaatcaaaagttgtctgcggacaggagctctctgacgtatgggcagagcgtgacggatgcttgtatcagtcttgaaaccactgctgaattgcttggagagctcgctgcttcagttgctcgagcaaggttcagctag

SEQ ID NO: 1388 - protein, 352 aa, Synechococcus sp. CC9311
MTTTHDLHVVDTRPLIPPALLHRDLPIDPTALETVVTARSRIQAILRGLDRRLLVIVGPCSVHDVEAARDYARRLAPLRERHAAELEIVMRVYFEKPRTTVGWKGLINDPHLDGSYDINTGLRMARSLLLDLAREGMPTATELLDPVVPQYIADLISWTAIGARTTESQTHREMASGLSMPIGYKNSTDGSATIAINAMQAAAKPHHFLGINREGHASIVSTSGNPNGHLVLRGGNRGTNYHLEAIQDSAAELTGAGLPDRLMVDCSHANSSKDFRRQSEVLQAVASQVDQKSDHVMGVMLESHLVEGNQKLSADRSSLTYGQSVTDACISLETTAELLGELAASVARARFS

SEQ ID NO: 1389 - DNA, 1065 bp, Shewanella sp. MR-4
  CDS (1)..(1065): transl_table=11
atgaccattaaaacagacgaattacgcacttccttattagctaaagtcatctcacctgcacaactggcatctgagtacccgttaacccaagatgcagccgattatctcgtacaacaacgtcgtgaagtcgaagccattattatgggcgaagatcaacgcctattagtgatcattggcccctgctcaatccatgatactcaagccgccctcgactacgctcgccgtttagcggtattgcaccaagagttaaaagacgatctctgcattttaatgcgtgtgtattttgaaaaaccccgcactatcgtcggttggaaagggttaatctccgatcctgatttagatggcagcttcgagccaaataaaggattacgtattgcccgtgagttactgcagcaaattactgaactgaagttaccgattgccaccgaatttttagacatggtgaatggtcaatatattgccgatttaatcacctggggcgctatcggtgcccgcaccaccgaaagccaagttcaccgcgaaatggcctcggcgctctcctgccccgttggctttaaaaacggtaccgatggcaatattaatatcgccgtcgatgcggtgcgcgcagcaaaagtgccacatatcttctattcaccggataaagatggcgccatgtcggtgtatcgcacccatggtaatccttacgggcatatcattttacgtggcggcaaaaaaccgaattactttgagcaagatattgaagaagcaagattaaagcttgagtcggtcaatgtgacgccgcgcgtggtagtcgattttagccacggcaacagtgaaaagaaccacctgaagcagcttgtggttgccgataatatcatggcgcaaatgcgcgcgggcagcacggcgattgccggggtgatggcagaaagtttcttacaggaaggcaatcaaaaagtggttgagggtcaacctctgtgttacggccaaagcatcacagatgcttgcctgcattgggatgactcggagaaattactgcgcgatctggctaaagcctcccgtgatagacgtgagttcctcggcaaataa

SEQ ID NO: 1390 - protein, 354 aa, Shewanella sp. MR-4
MTIKTDELRTSLLAKVISPAQLASEYPLTQDAADYLVQQRREVEAIIMGEDQRLLVIIGPCSIHDTQAALDYARRLAVLHQELKDDLCILMRVYFEKPRTIVGWKGLISDPDLDGSFEPNKGLRIARELLQQITELKLPIATEFLDMVNGQYIADLITWGAIGARTTESQVHREMASALSCPVGFKNGTDGNINIAVDAVRAAKVPHIFYSPDKDGAMSVYRTHGNPYGHIILRGGKKPNYFEQDIEEARLKLESVNVTPRVVVDFSHGNSEKNHLKQLVVADNIMAQMRAGSTAIAGVMAESFLQEGNQKVVEGQPLCYGQSITDACLHWDDSEKLLRDLAKASRDRREFLGK

SEQ ID NO: 1391 - DNA, 1092 bp, Shewanella sp. MR-4
  CDS (1)..(1092): transl_table=11
atgcaacaggatacgatcaataacgtacacatcagttcagagaaagttcttattacaccgcaggagctaaaagcggccctgccactctctgagcatgcgtatcgttatatcctcaatgcacgcaaaacagtggcggatattgtccataagcgcgataaccgcgtgcttatcgtcactggaccttgttctatccatgatatcgatgccgccaaggaatacgccttaaagcttaaaaaactacacgatgaactcagcgatgagttttacatcctgatgcgagtctactttgagaagccacgtaccacagtgggttggaaggggatgattaacgatcctgatatggacgagtccttcgatgttgagaagggtttaaagatggcccgtgagctgatgatttggttggccgaactcgaactgcctgtggcaaccgaagcgctcgatccgatcagcccacagtacatctcggaattagtcacttggtcggccattggtgctcgcacgactgagtcgcaaacccacagggaaatggcgtcgggtttatctatgcccgtcggctttaaaaatggcacagatggaaagctcgatgtagcgattaacgcgctgaaatcggcggccagcagccacagatttatggggattaaccagcagggccaagtggcgttattgcaaaccgcgggaaatcccgatggacatgtgatcctgcgtggcggcgccacgccaaactacgatgcaaagagcgttgccgagtgtgaagcgcagttacataaagccaaactcaatgctcgccttattatcgattgtagccacggtaattcgtctaaggactacacaaggcaagtccctgtgtgtgaagatgtatttgcccagatttacaacggcaataaatccatcattggcgtgatgttagaaagccatttaaatgaaggtaatcagagttgtgataaaccattgagcgaattggcctatggggtttctgtgacagactcctgtattaattgggaaaaaaccgaaagcgttttacgtgcgggcgcatcgaagttatcttcggtattagcaacccgtttcgatatgctcaaagtggccaatgcttaa

SEQ ID NO: 1392 - protein, 363 aa, Shewanella sp. MR-4
MQQDTINNVHISSEKVLITPQELKAALPLSEHAYRYILNARKTVADIVHKRDNRVLIVTGPCSIHDIDAAKEYALKLKKLHDELSDEFYILMRVYFEKPRTTVGWKGMINDPDMDESFDVEKGLKMARELMIWLAELELPVATEALDPISPQYISELVTWSAIGARTTESQTHREMASGLSMPVGFKNGTDGKLDVAINALKSAASSHRFMGINQQGQVALLQTAGNPDGHVILRGGATPNYDAKSVAECEAQLHKAKLNARLIIDCSHGNSSKDYTRQVPVCEDVFAQIYNGNKSIIGVMLESHLNEGNQSCDKPLSELAYGVSVTDSCINWEKTESVLRAGASKLSSVLATRFDMLKVANA

SEQ ID NO: 1393 - DNA, 1059 bp, Shewanella sp. MR-4
  CDS (1)..(1059): transl_table=11
atgtattaccaaaatgatgacgttcgcattaatgaagtcaaagagttacttccaccaattgcgattctagaacgatttcctgcctccgaaaacgctgctgcaactgtgtttaacgcccgtcaaagcattcataacattcttgcccgccaagatgatcgtttgttagtggtcattggtccttgctcaattcacgatcctaaggccgcattggaatatggccagcgattggttgcgctcagagaacgttatcaagatcagctcgaagtggtgatgcgtgtttattttgaaaagccgcgtactacagtgggttggaagggactcatcaacgatccttatatggataacagcttcaaactgaacgatggtttgcgtaccgcgcgtaaacttttagtcgatttgaatgactctggcatgccgaccgcgggtgagtttctcgatatgatcactccgcaatatgtggcggatatgatgtgctggggcgcgattggtgcgcgcaccactgaatcgcaggtgcaccgtgaattagcgtctgggttgtcttgccctgtaggctttaaaaatggcaccgacggcacgatcaaggtggcgattgatgccattggcgccgcgaatgcgccgcaccacttcttatcggtaaccaaatttggccattcggcgattgtgtcgaccaaaggtaatcctgattgccatatcattctgcgtggtggccgtgagcctaattacagtgccagccatgttgcgcagatcagcgaacaactgaaaaaggccaagcttgtcgataacattatgatcgactttagccatgccaatagcagcaaacaatatcaacgccagatggatgtcgcgaacgatgtggccgagcaagtggccgcgggtaataaggcaattttcggtgtgatggttgaaagccacttagtggaaggtcgccaagatctgattgaaggccaggcgttatgttatggccagagtattacggatgcctgtattggctgggatgataccgagcgtctgttagatgtgttaaatcagagcgttattgcacgccgccagcgggtctaa

SEQ ID NO: 1394 - protein, 352 aa, Shewanella sp. MR-4
MYYQNDDVRINEVKELLPPIAILERFPASENAAATVFNARQSIHNILARQDDRLLVVIGPCSIHDPKAALEYGQRLVALRERYQDQLEVVMRVYFEKPRTTVGWKGLINDPYMDNSFKLNDGLRTARKLLVDLNDSGMPTAGEFLDMITPQYVADMMCWGAIGARTTESQVHRELASGLSCPVGFKNGTDGTIKVAIDAIGAANAPHHFLSVTKFGHSAIVSTKGNPDCHIILRGGREPNYSASHVAQISEQLKKAKLVDNIMIDFSHANSSKQYQRQMDVANDVAEQVAAGNKAIFGVMVESHLVEGRQDLIEGQALCYGQSITDACIGWDDTERLLDVLNQSVIARRQRV

SEQ ID NO: 1395 - DNA, 1059 bp, Shewanella sp. MR-7
  CDS (1)..(1059): transl_table=11
atgtattaccaaaatgatgacgttcgcattaatgaagtcaaagagttacttccaccgattgcgattctagaacgatttcctgcctccgaaaacgctgctgcaactgtgtttaacgcccgtcaaagcattcataacattcttgcccgccaagatgatcgtttgttagtggtcattggtccttgctcaattcacgatcctaaggccgcattggaatatggccagcgactggttgcgctcagagaacgttatcaagatcagcttgaagtggtgatgcgtgtttattttgaaaagccacgtactacagtgggttggaagggactcatcaacgatccttatatggataacagcttcaaactgaacgatggtttacgtaccgcgcgtaaacttttagtcgatttgaatgactctggcatgcctaccgcaggtgagtttctcgatatgatcactccgcaatatgtggcggatatgatgtgctggggcgcgattggtgcgcgcaccacagaatcgcaggtgcaccgtgaattagcgtctgggttatcttgccctgtaggctttaaaaatggcaccgatggcacgatcaaggtggcgattgatgccattggcgccgcgaatgcgccgcaccactttttatcggtgaccaaatttggccattcggcgattgtgtcgaccaaaggtaatcctgattgccatatcattttgcgtggcggccgtgagcctaattacagtgccagccatgttgcgcagatcagcgaacaactgaaaaaagccaagcttgtcgacaacattatgatcgactttagccatgccaatagcagcaaacaatatcaacgccaaatggatgtcgcgaacgatgtggccgagcaagtggccgcgggtaataaggcgatttttggtgtgatggttgaaagccacttagtggaaggtcgccaagatctgattgaaggtcaggcgctatgttatggccagagcgttacggatgcctgtattggctgggatgataccgagcgtctgttagcggtgttaaatcagagcgttattgcacgccgccagcgggtctag

SEQ ID NO: 1396 - protein, 352 aa, Shewanella sp. MR-7
MYYQNDDVRINEVKELLPPIAILERFPASENAAATVFNARQSIHNILARQDDRLLVVIGPCSIHDPKAALEYGQRLVALRERYQDQLEVVMRVYFEKPRTTVGWKGLINDPYMDNSFKLNDGLRTARKLLVDLNDSGMPTAGEFLDMITPQYVADMMCWGAIGARTTESQVHRELASGLSCPVGFKNGTDGTIKVAIDAIGAANAPHHFLSVTKFGHSAIVSTKGNPDCHIILRGGREPNYSASHVAQISEQLKKAKLVDNIMIDFSHANSSKQYQRQMDVANDVAEQVAAGNKAIFGVMVESHLVEGRQDLIEGQALCYGQSVTDACIGWDDTERLLAVLNQSVIARRQRV

SEQ ID NO: 1397 - DNA, 1092 bp, Shewanella sp. MR-7
  CDS (1)..(1092): transl_table=11
atgcaacaggatacgatcaataacgtacacatcagttcagagaaagttcttattacaccgcaggagctaaaagcggtcctgccactctctgagcacgcgtatcgttatatcctcaatgcacgcaaaacagtggcggatattgtccataagcgcgataaccgcgtgcttatcgtcactggaccctgttctatccatgatatcgatgccgccaaggaatacgccttaaaacttaaaaaattacacgatgaactcagcgatgagttttacatcttgatgcgagtgtactttgagaagccacgtaccacagtgggttggaaggggatgattaacgatcctgatatggacgagtccttcgatgttgagaagggtttaaaaatggcccgtgagctgatgatttggttagccgaacttgaactgcctgtggcaaccgaagcgctcgaccctatcagcccacagtacatctcggaattagtcacttggtcggccattggtgcccgcacgactgagtcgcaaacccacagggaaatggcgtcgggtttatctatgcccgtcggctttaaaaatggcacagacggtaagctcgatgtagcaattaacgcgctgaaatcggcggccagcagccacagatttatggggattaaccagcagggccaagtggcgttattgcaaaccgcgggaaatcccgatggacatgtgatcctgcgtggcggcgccacgccaaactacgatgcaaagagcgttgccgagtgtgaggcgcagttacataaggccaaactcaatgctcgccttattatcgattgtagccatggtaattcctctaaggactacacaaggcaagtccctgtgtgtgaggatgtatttgaccagatctacaacggcaataagtccatcatcggcgtgatgttagaaagccatttaaacgaaggtaatcaaagttgtgataaaccattgagcgaattggcctatggggtttctgtgacagactcctgtattaattgggaaaaaaccgaaagcgttttacgtgggggcgcatcgaagttatcttcggtattagcaacccgtttcgatatgctcaaagtggccaatgcttaa

SEQ ID NO: 1398 - protein, 363 aa, Shewanella sp. MR-7
MQQDTINNVHISSEKVLITPQELKAVLPLSEHAYRYILNARKTVADIVHKRDNRVLIVTGPCSIHDIDAAKEYALKLKKLHDELSDEFYILMRVYFEKPRTTVGWKGMINDPDMDESFDVEKGLKMARELMIWLAELELPVATEALDPISPQYISELVTWSAIGARTTESQTHREMASGLSMPVGFKNGTDGKLDVAINALKSAASSHRFMGINQQGQVALLQTAGNPDGHVILRGGATPNYDAKSVAECEAQLHKAKLNARLIIDCSHGNSSKDYTRQVPVCEDVFDQIYNGNKSIIGVMLESHLNEGNQSCDKPLSELAYGVSVTDSCINWEKTESVLRGGASKLSSVLATRFDMLKVANA

SEQ ID NO: 1399 - DNA, 1077 bp, Alkalilimnicola ehrlichei MLHE-1
  CDS (1)..(1077): transl_table=11
atgtctgatcgtactgtggacgacctgaacgtcgagaagatcgagcacctccccacccccgccgagatcaaggcccagctgccgctcagcgagcaagcccgccgtctggtggtcgagggtcgggagaccgttcgcaacatcctggatggcaaggatcaccggctgttggtggtggtggggccctgttccatccacgaccccaaagcggcgctggactatgccaagcaactgaaagcgctgagtgatcaggtgggcgacagtctgttcatcgtcatgcgggtctattttgagaagccgcgcacggtgaccgggtggaaggggctgatcaacgaccccgacatggacgactccttccggatcgacaatggcctgttccaggcgcgcaaactgctgctggacctggctgagatgggactgcccacagccaccgaagcgctcgacccgatcatcccgcagtacctgcaggacctgatcacctggacggccattggtgcccgcaccaccgaatcgcagacccaccgcgagatggccagcggcctctccacgccggtcggattcaagaatggcaccgacggcagcctggacgtggccatcaacgccatgaagtccgccgcccatccgcacagcttcctgggcatcaactcccgcggcgagtgcagtatcatccggacccgcggcaacagctacggccacgtggtgctgcgcggcggccatggccagcccaattacgacagcgtgcacattgccctgtgcgagcaggagctggaaaaggcggggctgcccgcgcggatcgtggtcgactgcagccacgccaactccaacaaggacccggcgctgcagcccatggtgctgaaggacctggtgcaccagatcctggagggcaaccagtcgctggtgggcgtcatgctggagagcaacctgggctggggcaaccagaagctgggggccgatcccgctgccctcgactacggggtctccatcaccgatgcctgtatcgactggccgaccaccgagcagggtctgctggaggcggcggaaaagctgcgcgaggtgttgccccggcgggccgcggcctga

SEQ ID NO: 1400 - protein, 358 aa, Alkalilimnicola ehrlichei MLHE-1
MSDRTVDDLNVEKIEHLPTPAEIKAQLPLSEQARRLVVEGRETVRNILDGKDHRLLVVVGPCSIHDPKAALDYAKQLKALSDQVGDSLFIVMRVYFEKPRTVTGWKGLINDPDMDDSFRIDNGLFQARKLLLDLAEMGLPTATEALDPIIPQYLQDLITWTAIGARTTESQTHREMASGLSTPVGFKNGTDGSLDVAINAMKSAAHPHSFLGINSRGECSIIRTRGNSYGHVVLRGGHGQPNYDSVHIALCEQELEKAGLPARIVVDCSHANSNKDPALQPMVLKDLVHQILEGNQSLVGVMLESNLGWGNQKLGADPAALDYGVSITDACIDWPTTEQGLLEAAEKLREVLPRRAAA

SEQ ID NO: 1401 - DNA, 1062 bp, Rhizobium leguminosarum bv. viciae 3841
  CDS (1)..(1062): transl_table=11
gtgtctgataccattgacgatctgcgtatcgtcgaaattacccccctgaccaagcctgccgatatcatcgcggaaattccccgcaatgctgatgtcagtaagaccgtgaccagcaatcgcgatgcgatccaccaaattcttcggggcgaagacgatcgcctgatcgtcgtcatcggcccctgctcgatccatgatcccgttgccgccagggactatgccgctcggctcacggaacagcggcagcgcttcgccggcgatctcgagatcgtcatgcgcgtctatttcgaaaagccccgcaccaccgtcggctggaagggtctgatgaacgacccgcatctcgacggcagctaccgcattgaggaaggcttgcgcatcgccaggcgtctgctgctcgacatcaatgcgatgggccttcccgccggcgtcgaattcctcgacacgatcacgccgcagtacatcgccgacctcgtcagttggggcgcgatcggcgcgcgcacgaccgaaagccagatccatcgccagctcgcctccggcctctcctgcccgatcggcttcaagaacggcaccgacggcggcgtccgcgttgcgctggatgccatcctcgccgcctcgcagccgcatcacttcccggcggtaacgaaggacggccaagcggccatcgcctcgacgacaggcaatgaggattgccacatcatcctgcgcggtggcaagcggccgagctatgaagctgccgacgtcgaagcggtgaccggcgaagccgtcaagcttggcgtcgccccgcgcatcctcatcgatgccagccacgccaacagcggcaaggacccgatgaaccagccgctcgtcgtcaaatccgtcgccgcacagattgccgccggaaacagcgacatcaagggcatgatgatcgaaagcaacctcgtcgccggccgccaggatctcgttcccggcaaaccgctggtctacggccagtccatcaccgacggttgcatcgactgggagatgtcggtcgcagtgctggaagacctggcaaaatccgcccgcgagcgccgccggacccgcgcttaa

SEQ ID NO: 1402 - protein, 353 aa, Rhizobium leguminosarum bv. viciae 3841
MSDTIDDLRIVEITPLTKPADIIAEIPRNADVSKTVTSNRDAIHQILRGEDDRLIVVIGPCSIHDPVAARDYAARLTEQRQRFAGDLEIVMRVYFEKPRTTVGWKGLMNDPHLDGSYRIEEGLRIARRLLLDINAMGLPAGVEFLDTITPQYIADLVSWGAIGARTTESQIHRQLASGLSCPIGFKNGTDGGVRVALDAILAASQPHHFPAVTKDGQAAIASTTGNEDCHIILRGGKRPSYEAADVEAVTGEAVKLGVAPRILIDASHANSGKDPMNQPLVVKSVAAQIAAGNSDIKGMMIESNLVAGRQDLVPGKPLVYGQSITDGCIDWEMSVAVLEDLAKSARERRRTRA

SEQ ID NO: 1403 - DNA, 1077 bp, Pseudomonas aeruginosa UCBPP-PA14
  CDS (1)..(1077): transl_table=11
atggctgatttacagatcgacgaccttaacgttgcctccaacgagaccctgatcacgccggagcagctcaagcgtgaaattcccctgaccgacaaggccctgcagaccgtggcccatggtcgccaggtggtgcgcgacatcctggatggcaaggaccaccgtctgttcgtggtgatcggcccctgctccatccacgacatcaaggccgcccacgaatacgccgaccgcctcaaggcgctcgcggccgaagtggcggatacgctgttcctggtgatgcgcgtgtacttcgagaagccgcgtaccacggtgggctggaaaggcctgatcaacgatccgtacctggacgactcgttcaagatccaggatggcctgcacatcggtcgccaactgctccgcgacctcgccgagaaaggcttgcccaccgccaccgaagcgctcgacccgatttccccgcagtacctgcaggacctgatcagctggtcggcgatcggcgcccgtaccaccgaatcgcagacccaccgcgagatggcctccggcctgtcttccgcggtcggcttcaagaacggcaccgatggcagcctgaccgtggcgatcaatgccctgcagtcggtctccagcccgcatcgcttcctcggcatcaaccagcagggcggcgtatccatcgtcaccaccaagggcaaccgctacggtcacgtggtgttgcgcggcggcaacggcaagccgaactacgattcggtcagcgtcgcgctctgcgagcaggacctgaacaaggcgaaaatcccgctgaacatcatggtcgactgcagccacgccaactccaacaaggacccggccctgcaaccgctggtgatggacaacgtcagcaaccagatcgtcgaaggcaacaactcgatcgtcggcctgatggtggaaagccacctgggctggggcagccagccgattccgaaggatctcgaccaacttcagtacggcgtctccatcaccgacgcctgcatcgactgggcgaccaccgagaagagcatccgcagcatgcacgccaagctcaaggacgtgctgccgaaacgccagcgcggctga

SEQ ID NO: 1404 - protein, 358 aa, Pseudomonas aeruginosa UCBPP-PA14
MADLQIDDLNVASNETLITPEQLKREIPLTDKALQTVAHGRQVVRDILDGKDHRLFVVIGPCSIHDIKAAHEYADRLKALAAEVADTLFLVMRVYFEKPRTTVGWKGLINDPYLDDSFKIQDGLHIGRQLLRDLAEKGLPTATEALDPISPQYLQDLISWSAIGARTTESQTHREMASGLSSAVGFKNGTDGSLTVAINALQSVSSPHRFLGINQQGGVSIVTTKGNRYGHVVLRGGNGKPNYDSVSVALCEQDLNKAKIPLNIMVDCSHANSNKDPALQPLVMDNVSNQIVEGNNSIVGLMVESHLGWGSQPIPKDLDQLQYGVSITDACIDWATTEKSIRSMHAKLKDVLPKRQRG

SEQ ID NO: 1405 - DNA, 1065 bp, Shewanella sp. ANA-3
  CDS (1)..(1065): transl_table=11
atgaccattaaaacagacgaattacgcacttccttattagctaaagtcatctcacctgcacaactggcatctgagtacccgttaacccaagatgcagccgattatctcgttcagcaacgtcgtgaagtcgaagccattattatgggcgaagatcaacgcctattagtgatcattggcccctgctccatccatgatactcaagccgccctcgactacgctcgccgtttagcagtattgcatcaagagttgaaggacgatctctgcattttaatgcgcgtatattttgaaaagccacgcactatcgtcggttggaaagggttaatctccgatcctgatttagacggcagcttcgagccaaataaaggtttacgtattgcacgcgagttattgcagcaaatcacagagctcaaattaccgattgccaccgaatttttagatatggtgaacggtcaatacattgccgacctaatcacctggggcgctatcggtgcccgcaccaccgaaagccaagtccaccgcgaaatggcctcggcactctcctgccccgtgggctttaaaaacggtaccgatggcaatattaatatcgccgtcgatgcggtgcgcgcagcaaaagtgccacatatcttctattcgcctgataaagacggtgccatgtctgtctatcgcacccatggtaatccttacggccacatcattttacgtggcggtaaaaagccgaattactttgagcaagacattgaagaagcaagattaaaacttgagtctgtcgatgtaacaccacgtatggtggttgattttagccatggtaatagcgaaaagaatcacctgaagcagttagttgttgccgacaatatcatggcgcaaatgcgcgcaggcagcacggcaattgcgggggtgatggccgaaagtttcttacaggaaggcaatcaaaaagtggttgagggtcaacctctgtgttacggccaaagcatcacagatgcgtgcctgcattgggatgactcggaaaagttactgcgcgatctggctaaagcctcccgcgatagacgtgagtttctcggcaaataa

SEQ ID NO: 1406 - protein, 354 aa, Shewanella sp. ANA-3
MTIKTDELRTSLLAKVISPAQLASEYPLTQDAADYLVQQRREVEAIIMGEDQRLLVIIGPCSIHDTQAALDYARRLAVLHQELKDDLCILMRVYFEKPRTIVGWKGLISDPDLDGSFEPNKGLRIARELLQQITELKLPIATEFLDMVNGQYIADLITWGAIGARTTESQVHREMASALSCPVGFKNGTDGNINIAVDAVRAAKVPHIFYSPDKDGAMSVYRTHGNPYGHIILRGGKKPNYFEQDIEEARLKLESVDVTPRMVVDFSHGNSEKNHLKQLVVADNIMAQMRAGSTAIAGVMAESFLQEGNQKVVEGQPLCYGQSITDACLHWDDSEKLLRDLAKASRDRREFLGK

SEQ ID NO: 1407 - DNA, 1092 bp, Shewanella sp. ANA-3
  CDS (1)..(1092): transl_table=11
atgcaacaggatacgatcaataacgtacacatcagttcagagaaagttcttattacaccgcaggagctaaaagcgactctgccactctctgagcacgcgtatcgttatatcctcaatgcacgcaaaaccgtggcggatattgtccataagcgtgataaccgcgtgcttattgtcaccggaccttgctctatccatgatatcgatgccgccaaggaatacgccttaaagcttaaacaactccacgatgaactcagcgatgagttttacatcttgatgcgagtctactttgagaagccacgtaccacagtgggttggaaggggatgattaacgatcctgatatggatgaatccttcgatgtcgagaagggcttgaagatggcccgtgagctgatgatttggttggccgaactcgaactgcctgtggcaaccgaagcgctcgaccctatcagcccgcagtacatctcagaattagtgacttggtcagccattggtgcccgcacgactgagtcgcaaacccacagggaaatggcgtcgggtttatctatgcccgtcggttttaaaaatggtacagacggaaagctcgatgtagccattaacgcgctgaaatcggcggctagtagccacagatttatggggattaaccaacagggccaagtcgcgttattgcaaactgcgggtaacccagatgggcatgtgatcctccgcggtggcgcaacgccaaactacgatgctcagagcgtcgccgaatgtgaggcgcagttacataaggccaaactcaatgcgcgccttatcatcgattgcagccacggtaattcctctaaggattacaccaggcaaattccggtgtgtgaagatgtatttaaccaaatctacaacggcaataagtccatcattggcgtgatgttagaaagccatttaaatgaaggtaatcaaagttgtgataaaccattgagcgaactggcctatggggtttctgtgacagactcctgtattaattgggaaaaaaccgaaagcgttttacgtgcgggcgcatcgaagttatcttcggtattagcaacccgtttcgatatgctcaaagtggccaatgcttaa

SEQ ID NO: 1408 - protein, 363 aa, Shewanella sp. ANA-3
MQQDTINNVHISSEKVLITPQELKATLPLSEHAYRYILNARKTVADIVHKRDNRVLIVTGPCSIHDIDAAKEYALKLKQLHDELSDEFYILMRVYFEKPRTTVGWKGMINDPDMDESFDVEKGLKMARELMIWLAELELPVATEALDPISPQYISELVTWSAIGARTTESQTHREMASGLSMPVGFKNGTDGKLDVAINALKSAASSHRFMGINQQGQVALLQTAGNPDGHVILRGGATPNYDAQSVAECEAQLHKAKLNARLIIDCSHGNSSKDYTRQIPVCEDVFNQIYNGNKSIIGVMLESHLNEGNQSCDKPLSELAYGVSVTDSCINWEKTESVLRAGASKLSSVLATRFDMLKVANA

SEQ ID NO: 1409 - DNA, 1059 bp, Shewanella sp. ANA-3
  CDS (1)..(1059): transl_table=11
atgtattaccaaaatgatgacgttcgcattaatgaagtcaaagagttacttccaccgattgcgattctagaacgatttcctgcttccgaaaacgctgctgcaactgtgtttaacgcccgtcaaagtatccataacattctcgctcgccaagatgatcgtttgttagtcgtcattggtccttgctcaatccatgatcctaaggccgcattggaatacggccagcgactggttgcgctaagagaacgttatcgagatcagctcgaagtggtgatgcgtgtttattttgaaaagccgcgtaccacagtgggttggaagggactcatcaacgatccttatatggataacagcttcaaactgaacgatggtttgcgtaccgcgcgtaaactcttggtcgatttgaatgactcaggcatgcctaccgcgggtgaattcctcgatatgatcaccccgcaatatgtggcggatatgatgtgctggggcgccatcggcgcgcgcaccacagaatcgcaggtacaccgcgagctggcctcggggctgtcttgccctgtaggctttaaaaatggtaccgatggcacgattaaggtggcaatcgatgccattggcgccgcgaatgcgccgcaccacttcttatcggtaaccaaatttggccattcggcgattgtgtcgactaaaggtaatcctgattgccatatcattctgcgcggcggccgtgagccaaattacagtgccagccatgtggcgcagatcagcgaacaactgaaaaaggccaagctggtcgataacataatgatcgatttcagccatgccaacagcagcaaacaatatcaacgccaaatggaagtcgcgaacgatgtggccgaacaaatggctgcgggtaataaggcgattttcggtgtgatggtcgaaagccacttagtggaagggcgtcaggatctgattgaaggtcaagcgttatgctacggtcagagcatcacagatgcctgtattggttgggacgataccgagcgtttactcgcagtgttaaatcagagtgttatcgaacgtcgtcagcgggtttaa

SEQ ID NO: 1410 - protein, 352 aa, Shewanella sp. ANA-3
MYYQNDDVRINEVKELLPPIAILERFPASENAAATVFNARQSIHNILARQDDRLLVVIGPCSIHDPKAALEYGQRLVALRERYRDQLEVVMRVYFEKPRTTVGWKGLINDPYMDNSFKLNDGLRTARKLLVDLNDSGMPTAGEFLDMITPQYVADMMCWGAIGARTTESQVHRELASGLSCPVGFKNGTDGTIKVAIDAIGAANAPHHFLSVTKFGHSAIVSTKGNPDCHIILRGGREPNYSASHVAQISEQLKKAKLVDNIMIDFSHANSSKQYQRQMEVANDVAEQMAAGNKAIFGVMVESHLVEGRQDLIEGQALCYGQSITDACIGWDDTERLLAVLNQSVIERRQRV

SEQ ID NO: 1411 - DNA, 1062 bp, Mycobacterium avium 104
  CDS (1)..(1062): transl_table=11
atgtccctcaccgaatgcgccaccgcggccgtcgatacctccgatcaccggatcgtgtcgtttcgggaactgtcggcgccggccgcgattcgcgccgaactgccgctgacgccccggcgcgcccgagcggtccagcgcgaccgcgacgacatcgcggccatcctggccggtgctgacgaccggctgctcctggtggtcggcccctgctcggtgcacgatccggtcgccgcgctcgactacgcgcgccggctcgcgccgatcgccgccgagttcgcggaccggctgaagatcgtgatgcgcgtctacttcgaaaagccgcgcaccaccatcggctggaagggtctgatcaacgaccccgccatggacagcagcttcgacgtggagcgcggcatccgcaccgcgcgtgcgctgctgctcgacatcatcgacgtgggcctgccggtgggatgtgaattcctggaacccaccagcccgcagtacatcgccgacgccgtcgcgtggggcgcgatcggcgcccggaccaccgaatcgcaggtgcaccgccaactggcgtcggggctgtcgatgccgatcgggttcaagaacggcaccgacggtaacgtccaggtcgccatcgacggtgtcaaggccgcggcggcgccgcaccacttcttcggaaccgacgacgtgggccgggccgccgtcgtcgagaccatgggcaaccccgactgccatgtgatcctgcgcggcggcaccgccggacccaactacgacgccggctcggtggccggcgccatcgaacggttaagtgcggcagggctttccccgcgggtcatggtcgactgctcacacgccaactccgccaaggaccatgtgcggcaagccgaagtcgccgccgaactgatcgcccgcatcgccgccggcgagcgcgggatcgggggcctgatgctggaaagcttcctggtggccggtgcccaaccgctcggcggcgaactgacctacggccaatccgtcaccgatgaatgcatggattttgcgaccacggcccggttgctggccgggttgtacgcggcgatgggctga

SEQ ID NO: 1412 - protein, 353 aa, Mycobacterium avium 104
MSLTECATAAVDTSDHRIVSFRELSAPAAIRAELPLTPRRARAVQRDRDDIAAILAGADDRLLLVVGPCSVHDPVAALDYARRLAPIAAEFADRLKIVMRVYFEKPRTTIGWKGLINDPAMDSSFDVERGIRTARALLLDIIDVGLPVGCEFLEPTSPQYIADAVAWGAIGARTTESQVHRQLASGLSMPIGFKNGTDGNVQVAIDGVKAAAAPHHFFGTDDVGRAAVVETMGNPDCHVILRGGTAGPNYDAGSVAGAIERLSAAGLSPRVMVDCSHANSAKDHVRQAEVAAELIARIAAGERGIGGLMLESFLVAGAQPLGGELTYGQSVTDECMDFATTARLLAGLYAAMG

SEQ ID NO: 1413 - DNA, 1053 bp, Mycobacterium smegmatis str. MC2 155
  CDS (1)..(1053): transl_table=11
atgaatctggcgcagatcgccaacccgcccgcgacgtcggatcggcgtatccgcagcttcagcgcgatccccagcccgcacgacgtgctcaccgaattcccgctgggtgcccgtcgcgccgagcgtgtggccgccgaccgcgacgaggtcgccgacatcctcgcaggccgcgacaaccggctgctggtcgtggtgggcccgtgctcggtgcacgacccggccgccgcgctcgaatacgcgagccgtctggtcaaggtggccgaggagctcaaggacaccgtcaagatcgtgatgcgggtgtatttcgagaagccgcgcaccacgatcggctggaagggcctgatcaacgatccgggcatggacggcacgttcgacgtcgcgcgcggtctgcgcatcgcacgtcaactgctgctcgacatcatcgacatcggtctgccggtcgggtgtgagttcctggagcccaccagcccgcagtacatcgccgacgccgtcgcgtggggcgcgatcggtgcccgcaccaccgagtcgcaggtgcaccgtcagctggcctcgggcctgtcgatgccggtgggcttcaagaacggcaccgacggcaacgtccaggtcgccgtggacggcgcgaaatccgccgcggccgagcacgtgttcttcggcatggacgacatgggccgcggcgccgtggtgagcaccgccggcaacgaggactgccacgtgatcctgcgcggcggcacccggggacccaattacgacgccgagtcggtgcgggccgccgccgccaagctggccaaggcgggactgcccggtcgcgtcgtgatcgattgcagccacgccaattccggcaaggaccacatccgccaggccgtcgtcgcgaccgaggtcgcccagatggtgcgtgacggtcagccgatcagcggtgtgatgctggagagcttcctcgtcggtggtgcgcagagcccggacgcagagacgctgacctacggccagtccgtcaccgacaagtgcatggattgggacgcaaccgatctcgtgctgcgcgagctcgcccggcgttag

SEQ ID NO: 1414 - protein, 350 aa, Mycobacterium smegmatis str. MC2 155
MNLAQIANPPATSDRRIRSFSAIPSPHDVLTEFPLGARRAERVAADRDEVADILAGRDNRLLVVVGPCSVHDPAAALEYASRLVKVAEELKDTVKIVMRVYFEKPRTTIGWKGLINDPGMDGTFDVARGLRIARQLLLDIIDIGLPVGCEFLEPTSPQYIADAVAWGAIGARTTESQVHRQLASGLSMPVGFKNGTDGNVQVAVDGAKSAAAEHVFFGMDDMGRGAVVSTAGNEDCHVILRGGTRGPNYDAESVRAAAAKLAKAGLPGRVVIDCSHANSGKDHIRQAVVATEVAQMVRDGQPISGVMLESFLVGGAQSPDAETLTYGQSVTDKCMDWDATDLVLRELARR

SEQ ID NO: 1415 - DNA, 1086 bp, Azoarcus sp. BH72
  CDS (1)..(1086): transl_table=11
atgtccgcctcaatgaagatccatatcgacgacgtccgcatcaaggagatcaaggaactggtgccgcccgcccatgtgctgcgcgagtttccggcgaccgccaagtccgcggaaacggcgtacgaggcgcgccaggcgatccaccgcatcctctacggcgccgacgaccgcctgctggtggtggtggggccgtgctccatccacgatgctgacgcggcgatggaatatgcccgccgcctgaaggtcgaggctgagcggctgaagaacgacctgctggtggtgatgcgggtgtatttcgagaagccgcgcaccacggtgggctggaagggcctgatcaatgacccccacctggacggcagcttcgcgatcaacgaaggcgtacggctcgcgcgcaagctgctgtgggaaatcaacgaactcggcctgcccgccggcaccgagttcctcgacatgatcacgccgcagtacatcgccgacctgatcagctggggcgcgatcggcgcccgcaccaccgagagccaggtgcaccgcgaactggcctccggcctgtcgtgcccggtgggcttcaagaacggcaccgacggcaacgtacgcatcgcggtcgatgcgatcaaggcggcgcagtcgccgcatcatttcctcagcgtcaccaaggcgggccactcggccatcgtctccacccgcggcaacgaggactgccacgccatcctgcgcggcggcaagagcaccaactacgatgccgccagcgtggatgccgcgtgcaaggaactcgcggcctccggcgtgccgggcaaggtcatgatcgacttctcgcacgccaacagccgcaagcagcaccgcctgcagatcgaggtggcgcacgacgtcgcggcccagctggcgcgcggcgaggaccgcatcatcggggtgatggtggagtcccacctgaaggaaggccgtcaggacctcaagccgggctgcacgctggaatacggcatgagcatcaccgacgcctgcatcggctgggaagactcggtcggcgtgctcgacacgctggccggcgccgtgcgccagcgccgcgtggagcgcgcggccgagacggagtaa

SEQ ID NO: 1416 - protein, 361 aa, Azoarcus sp. BH72
MSASMKIHIDDVRIKEIKELVPPAHVLREFPATAKSAETAYEARQAIHRILYGADDRLLVVVGPCSIHDADAAMEYARRLKVEAERLKNDLLVVMRVYFEKPRTTVGWKGLINDPHLDGSFAINEGVRLARKLLWEINELGLPAGTEFLDMITPQYIADLISWGAIGARTTESQVHRELASGLSCPVGFKNGTDGNVRIAVDAIKAAQSPHHFLSVTKAGHSAIVSTRGNEDCHAILRGGKSTNYDAASVDAACKELAASGVPGKVMIDFSHANSRKQHRLQIEVAHDVAAQLARGEDRIIGVMVESHLKEGRQDLKPGCTLEYGMSITDACIGWEDSVGVLDTLAGAVRQRRVERAAETE

SEQ ID NO: 1417 - DNA, 1059 bp, Nostoc punctiforme PCC 73102
  CDS (1)..(1059): transl_table=11
atgcacaacaaattatttaatagtaatatcgacaacgctaacattgagaacgatcgcattttattaactcccaatgaaataaaatcaaaattacctttaacacaattagccgaacaaagagttttagcatacaggcaggaaatagaagatattctcgattttcaggatcggagaaagtttatagtagttgggccatgctcaatccacgacccaaaagcagcgctcgaatattctgaaaggttgaaagcgttgtctgaggaagttaaggataagctactactaataatgcgtgtatactttgaaaagccaagaacaaccgtcggttggaaaggattaattaacgatccagatatggatgattctttccatgtagagaatggtttattaattgcacgcgatttgttattaaaaattacagaattgggattacctgcgggtacagaagcactagatccaatcatacctcaatacattagtgaactgattacctggtctgctattggggcacgcacgaccgaatcacaaactcaccgtgaaatggcaagtgggctttcgatgcctgtgggttttaaaaacggtactgatggcaatattcaagtagctttgaatgccctacaatcagctagaaacccgcataattttctgggaattaatcaaaacggacaagtcagcgtctttcaaactaaagggaatggctatggtcacgtaattttaagaggtggtagtcaacccaactttgatgcagctaatgtcaaattagtagaagataaattaaaacaggcgaatttaccaccaagaattgtgatcgactgtagccacggaaatactaataaagattacaaattacaaggtgctgttttagaaaatattattcagcaaatagtagatggtaatacatcaatagttggcatgatgctggaatcacatttgtatgaaggtagtcaaccaattaccgataaacaagaagaattaaaatatggggtttctgtaactgataaatgtattagttgggaagaaaccgaaaaaattattttggctgcttacgaaaaacttaagtaa

SEQ ID NO: 1418 - protein, 352 aa, Nostoc punctiforme PCC 73102
MHNKLFNSNIDNANIENDRILLTPNEIKSKLPLTQLAEQRVLAYRQEIEDILDFQDRRKFIVVGPCSIHDPKAALEYSERLKALSEEVKDKLLLIMRVYFEKPRTTVGWKGLINDPDMDDSFHVENGLLIARDLLLKITELGLPAGTEALDPIIPQYISELITWSAIGARTTESQTHREMASGLSMPVGFKNGTDGNIQVALNALQSARNPHNFLGINQNGQVSVFQTKGNGYGHVILRGGSQPNFDAANVKLVEDKLKQANLPPRIVIDCSHGNTNKDYKLQGAVLENIIQQIVDGNTSIVGMMLESHLYEGSQPITDKQEELKYGVSVTDKCISWEETEKIILAAYEKLK

SEQ ID NO: 1419 - DNA, 1062 bp, Actinobacillus pleuropneumoniae serovar 1 str. 4074
  CDS (1)..(1062): transl_table=11
atgaacaccgtagttaatcaggatagtttgcataatgtgaatattgttgatgaaaaagtattactcaccccggccgagctaaaagccgaattacctttgcccgaatatctacgtaaacaaattgaaacatcgcgtcgagaaatctcggatattatccataaacgtgatcagcgtaaattaattgtgattggtccttgttctattcatgatccgattgccgccatcgaatacggcaaaaaattaaaggcgttagccgataccgtgtcggataaactttacatcgtcatgcgtgtatattttgaaaaaccgcgtactaccgtgggctggaaagggctgattaacgatccgaaaattgacgggactttcgatgtcgaaaccggcttacgtgtcgggcgtaagctctgtttggacctcgccgaattaggtttaccgttagcaaccgaagcacttgatccgatgacgccgcagtatttggctgatctcttcagttggtcggcgattggtgccagaacgaccgaatcgcaaacacaccgagaattggcttccggtttatctatggcggtcggttttaaaaacggcacggacggcagtttatccgtagcgattaatgcaatgcaatccgccgcacaaagccatagctttatcggcatcaaccaaaaaggtcaggtgaatttattgcatactaagggtaatccggatagccatgtgattctacgcggcggaaaaacacctaattttgaaaaacaatatgtggaagaatgtgaagccgcactacgtaaagccggtttagcggaagcgattatgattgactgtagccacggtaactcgaataaagattaccgtcgccaaccgcttgttgcggaagatgccttatcacaattattagccggcaatacttccattatcggtttaatgatcgaaagccacttaaatgccggtaaccaatcttctgatcaggctttcaatcaaatgcaatacggcgtatccattaccgacgcttgtatcgattggcaaacgacagaaaatctcttaaccgattttgctgaaaaattaagagcttaa

SEQ ID NO: 1420 - protein, 353 aa, Actinobacillus pleuropneumoniae serovar 1 str. 4074
MNTVVNQDSLHNVNIVDEKVLLTPAELKAELPLPEYLRKQIETSRREISDIIHKRDQRKLIVIGPCSIHDPIAAIEYGKKLKALADTVSDKLYIVMRVYFEKPRTTVGWKGLINDPKIDGTFDVETGLRVGRKLCLDLAELGLPLATEALDPMTPQYLADLFSWSAIGARTTESQTHRELASGLSMAVGFKNGTDGSLSVAINAMQSAAQSHSFIGINQKGQVNLLHTKGNPDSHVILRGGKTPNFEKQYVEECEAALRKAGLAEAIMIDCSHGNSNKDYRRQPLVAEDALSQLLAGNTSIIGLMIESHLNAGNQSSDQAFNQMQYGVSITDACIDWQTTENLLTDFAEKLRA

SEQ ID NO: 1421 - DNA, 1074 bp, Actinobacillus pleuropneumoniae serovar 1 str. 4074
  CDS (1)..(1074): transl_table=11
atgtcttataaaaatgatgatcttcgtattacgaatattgaacaacttttaccgccggttgcgctattggaacgttttcccgcaagcgatattgccgccgaaaccgtagaaaaagcacgtaaagccattcataaaattattcacggtgcggacgaccgtttattggtggtgatcggaccttgttccatccatgatcctaaagcggcgctagagtatgcacaacgtataaaaacaattcgtgcgaatcctaagattaatcaaaaccttgaagtggtaatgcgcgtttattttgaaaaaccgcgcacgaccgtcggttggaaagggttaatcaatgatccttatcttaacgaaacttacgcgttaaacgacggtttacgtatcgctcgtaaagtattatcggatattaacgatttaaccgtaccggcggcaggcgaatttttagatatgatcacaccgcaatatatggcggactttatgagttggggtgcaatcggcgcacgcacgaccgaatcgcaagttcatcgtgaattagcatccggtttatcttgtgcggtcggctttaaaaatgcgacaaacggcggtgtaaaaatcgcattagatgcaatcggtgcggcggaagctccgcatcatttcttatcagtcaccaaattcggacattccgcaattgtttctacggcaggtaatccggattgccatatcattttacgcggcggtgataaagggacgaactatgatgccgaatcggtcgccaaagtatgtgcggatatcgagaaatccggtcgccgaccgcacgtaatgattgatttcagtcatgccaacagccaaaaacaatttaaacgtcagatggacgtttgtgcggacgtatgccgacaaattgcaagcggttcggaactaatttccggtgtgatgattgaaagtcatttagtggaaggtcgccaagaattaggtgacggtaatttagcgcatttggtttacggacaaagtgtaacggatgcctgtatcggttgggaagatagcgaaaaagcgttgtttgccttggctgatgcggttgaacaacgccgcaaacatatttaa

SEQ ID NO: 1422 - protein, 357 aa, Actinobacillus pleuropneumoniae serovar 1 str. 4074
MSYKNDDLRITNIEQLLPPVALLERFPASDIAAETVEKARKAIHKIIHGADDRLLVVIGPCSIHDPKAALEYAQRIKTIRANPKINQNLEVVMRVYFEKPRTTVGWKGLINDPYLNETYALNDGLRIARKVLSDINDLTVPAAGEFLDMITPQYMADFMSWGAIGARTTESQVHRELASGLSCAVGFKNATNGGVKIALDAIGAAEAPHHFLSVTKFGHSAIVSTAGNPDCHIILRGGDKGTNYDAESVAKVCADIEKSGRRPHVMIDFSHANSQKQFKRQMDVCADVCRQIASGSELISGVMIESHLVEGRQELGDGNLAHLVYGQSVTDACIGWEDSEKALFALADAVEQRRKHI

SEQ ID NO: 1423 - DNA, 1089 bp, Haemophilus influenzae R2846
  CDS (1)..(1089): transl_table=11
atggctaaagagaaaattgaaattgtcgtggcaaacgatgatacgcgaattgaaaaagtcgatcaggtgttaccaccgattgccttattagaaaaatatccagctagtgaacaggctgcggcattagtaaagcaaactcgtcatgaggcgcataatattattcaggctaaagatgatcgtttattagtcgtgattggaccttgctccattcacgatccgaaagctgccattgaatatgcgactcgtttaaaaccattacgtgataaatataaagatagcctcgaaattattatgcgtgtgtactttgagaaaccgcgtacaacggtgggctggaaaggtttaattaatgatccgtatttaaatgatacttatcgtttaaatgatggtttacgtattgcacggaaattactttcagatattaatgatcttggtgtgcctgctgcgggcgagtttttagatatgattacacctcaatatttggctgattttatgagctggggggcgattggggctagaacaacagaatcacaagttcatcgtgagttggcttcaggtttatcttgtgctgttggttttaaaaatgccactaatggcggagtaaaagtcgctttagatgcaattggtgcggcagaagctccccactatttcttatctgtcactaaatttggtcattctgccattgtttctacaaaagggaatgaagattgccatattattttacgaggtggagataaaggccctaactatagtgctgaagatgtagaaaaagtttgtgctgatattgaaaaaacagggcgtattccacacgttatggttgattttagccatgcaaacagcagtaaacaatataaaaaacaaatggaggtttgccaagatgtgtgtcatcaaatcgcatctggttctaaacaaatctttggtgtaatggtggaaagtcatttagtggaaggtcgtcaagatttagttgatggcaaagcgcagacttatggacaaagtattacggatgcgtgcattggatgggaagattctgaaagattattgcaacaactttctgatgcagttattgctagacgtaaagcgacgagtaattaa

SEQ ID NO: 1424 - protein, 362 aa, Haemophilus influenzae R2846
MAKEKIEIVVANDDTRIEKVDQVLPPIALLEKYPASEQAAALVKQTRHEAHNIIQAKDDRLLVVIGPCSIHDPKAAIEYATRLKPLRDKYKDSLEIIMRVYFEKPRTTVGWKGLINDPYLNDTYRLNDGLRIARKLLSDINDLGVPAAGEFLDMITPQYLADFMSWGAIGARTTESQVHRELASGLSCAVGFKNATNGGVKVALDAIGAAEAPHYFLSVTKFGHSAIVSTKGNEDCHIILRGGDKGPNYSAEDVEKVCADIEKTGRIPHVMVDFSHANSSKQYKKQMEVCQDVCHQIASGSKQIFGVMVESHLVEGRQDLVDGKAQTYGQSITDACIGWEDSERLLQQLSDAVIARRKATSN

SEQ ID NO: 1425 - DNA, 1089 bp, Haemophilus influenzae R2866
  CDS (1)..(1089)
atggctaaagagaaaattgaaattgtcgtggcaaacgacgatacgcgaattgaaaaagtcgatcaggtgttaccacccattgccttattagaaaaatacccagcaagtgaacatgctgcggcgttagtgaagcaaactcgtcatgaggcacataatattattcatggtaaagatgatcgtttattagtcgtgattgggccttgctctattcatgatccgaaagttgccattgaatatgcgactcgtttaaaaccattacgtgaaaaatacaaagatagccttgaaattattatgcgtgtgtattttgagaaaccgcgtacaacggtgggttggaaaggtctaattaatgatccatatttgaatgatacttatcgtttaaatgatgggttacgtattgcacggaaattactttcagatattaatgatcttggtgtgcctgcagcgggcgagtttttagatatgattacacctcagtatttggcagattttatgagctggggggcgattggggctagaacaacagaatcacaagttcatcgtgagttggcttcaggtttatcttgtgctgttgggtttaaaaatgccactaatggtggtgtgaaagtcgctttagatgcaattggtgcggcggaagctccccactatttcttatctgtcactaaatttggtcattctgcaattgtttctacaaaagggaatgaagattgccatattattttacgaggtggagataaaggccctaactatagtgctgaagatgtagaaaaagtttgtgctgatattgaaaaaacagggcgtattccacacgttatggttgattttagccatgcaaacagcagtaaacaatataaaaagcaaatggatgtttgccaagacgtatgtaatcagattgcatttggttctaaacaaatctttggcgtaatggtggaaagccatttagtggaaggtcgtcaagatttagttgatggcaaagcgcagacttatggacaaagtattacggatgcgtgcattggatgggaagattctgaaagattattgcaacaactttctgatgcagttattgctagacgtaaagcgacgagtaattaa

SEQ ID NO: 1426 - protein, 362 aa, Haemophilus influenzae R2866
MAKEKIEIVVANDDTRIEKVDQVLPPIALLEKYPASEHAAALVKQTRHEAHNIIHGKDDRLLVVIGPCSIHDPKVAIEYATRLKPLREKYKDSLEIIMRVYFEKPRTTVGWKGLINDPYLNDTYRLNDGLRIARKLLSDINDLGVPAAGEFLDMITPQYLADFMSWGAIGARTTESQVHRELASGLSCAVGFKNATNGGVKVALDAIGAAEAPHYFLSVTKFGHSAIVSTKGNEDCHIILRGGDKGPNYSAEDVEKVCADIEKTGRIPHVMVDFSHANSSKQYKKQMDVCQDVCNQIAFGSKQIFGVMVESHLVEGRQDLVDGKAQTYGQSITDACIGWEDSERLLQQLSDAVIARRKATSN

SEQ ID NO: 1427 - DNA, 1125 bp, Rubrivivax gelatinosus PM1
  CDS (1)..(1125): transl_table=11
atgaatgccctgtccgccaacgttcccgagggttgggccgcgcccgccgacaagaccagccagaccgatgacgaacggatcgaggacgtgatgccactgccgccgcccgagcacctgatccgcttcttcccggtgcgcggcacgcccgtcgaggagctggtgtccagcacccgccgccgcatccgcgacatcatgcgcggcaatgacgaccgcctgctggtcatcatgggcccgtgctcgatccacgacccggtggcggcggtggactacgcgcgcaagctcaaggcccagcgcgacaagtacgccgacacgctggagatcgtgatgcgcgtgtacttcgagaagccgcgcaccaccgtcggctggaagggcctgatcaatgacccctacctcgacgagagcttccgcatcgacgaaggcctgcgcattgcgcgccagctgctgctggagatcggccgcctcgggctgccggccggcagcgagttcctcgacgtgatctcgccgcagtacatcggcgacctgatctcctggggcgccatcggtgcgcgcaccaccgaaagccaggtccaccgcgagctcgcctcgggcatcagcgcgccgatcggcttcaagaacggcaccgacggcaacatcaagatcgccacggacgccatccagtccgccagccggccgcaccacttcctgtcggtgcacaagaacggccaggtcgcgatcgtcgagacccgcggcaacgccgattgccacgtcatcctgcgcggcggcaagacgccgaactacgacgccagcagtgtcggggcggcctgcgccgaactcggcaaggccgggctgccggcctcgctgatggtcgactgctcccacgccaacagcagcaagcagcaccagaagcagatcgacgtggcgcgcgacgtcgccgaccagttggccggcggcagccgccaggtcttcggcgtgatggtcgagagccacctgagcgccggcgcccagaagttcagcgcgggcaaggacgacccggcgaagctcgcctacggccagagcatcacggacgcctgcatcggctgggacgattcactggaggtgctgggcgtgctcagcgccgcggtggcggcccggcgcggacggggctga

SEQ ID NO: 1428 - protein, 374 aa, Rubrivivax gelatinosus PM1
MNALSANVPEGWAAPADKTSQTDDERIEDVMPLPPPEHLIRFFPVRGTPVEELVSSTRRRIRDIMRGNDDRLLVIMGPCSIHDPVAAVDYARKLKAQRDKYADTLEIVMRVYFEKPRTTVGWKGLINDPYLDESFRIDEGLRIARQLLLEIGRLGLPAGSEFLDVISPQYIGDLISWGAIGARTTESQVHRELASGISAPIGFKNGTDGNIKIATDAIQSASRPHHFLSVHKNGQVAIVETRGNADCHVILRGGKTPNYDASSVGAACAELGKAGLPASLMVDCSHANSSKQHQKQIDVARDVADQLAGGSRQVFGVMVESHLSAGAQKFSAGKDDPAKLAYGQSITDACIGWDDSLEVLGVLSAAVAARRGRG

SEQ ID NO: 1429 - DNA, 1131 bp, Burkholderia vietnamiensis G4
  CDS (1)..(1131): transl_table=11
atgcataacctcgacaatccctcccacgatcgcgaggtaggcagcgccgacgcgacgcaagacacgacccgcatcgacgacgtccgcatcggcgccgtgcgcccgctgatctcgcccgcgctgctgcaggacgagctgccggtgccggccggcacgcagacgctcgtcgaggacacgcggcgcgcgatcggcgacatcctgcacggccgcgacgaccggctgctggtcgtcgtcggcccgtgctcgatccacgaccacgaccaggcgctcgagtacgcgcgccgcctgaaggccgccgccgacgcgctgcaggacgatctgctgatcacgatgcgcgtgtacttcgagaagccgcgcacgacggtcggctggaagggctacatcaacgatccgcgtctggacggcagcttccgcatcaacgaagggctgcgcgcggcacgacagctgctgctcgacatcaacgcgctcggcctgccggcgtcgaccgaattcctcgacctgctgagcccgcagtacatcgcggatctgatcgcgtggggcgccatcggcgcgcgcaccaccgagagccagagccatcgtcagcttgcatcgggcctgagctgcccgatcggcttcaagaacggtaccgacggcggcgtgcaggtcgcggccgatgcgatcgtcgccgcgcgcgcgagccacgcgttcatgggaatgacgaagatgggcatggccgcgatcttcgagacgcgcggcaacgacgacgcgcacgtgatcctgcgcggcggcaagaatggtccgaactacgacgccgagcacgtcgaagcgagctgcgcggtgctgcgcaagagcgggttgcgcgagcaggtgatggtcgattgctcgcatgcgaattcgaacaagtcgcacgagcggcagatcgacgtcgcgcaggatctcgcgcgccagctgtcgcagggcgagcagcgcatcatcggcgtgatggtggagagccatctcgaggccggccgtcaggatctgaagccgggcgtgccgctgaagtacggcgtgtcgatcaccgatgcatgtctgagctggtcgcagacggagccggtgctcgacgtgctcgcgcaagccgtgcggcagcgccgcggcgcgtcgcgcaacgcgtga

SEQ ID NO: 1430 - protein, 376 aa, Burkholderia vietnamiensis G4
MHNLDNPSHDREVGSADATQDTTRIDDVRIGAVRPLISPALLQDELPVPAGTQTLVEDTRRAIGDILHGRDDRLLVVVGPCSIHDHDQALEYARRLKAAADALQDDLLITMRVYFEKPRTTVGWKGYINDPRLDGSFRINEGLRAARQLLLDINALGLPASTEFLDLLSPQYIADLIAWGAIGARTTESQSHRQLASGLSCPIGFKNGTDGGVQVAADAIVAARASHAFMGMTKMGMAAIFETRGNDDAHVILRGGKNGPNYDAEHVEASCAVLRKSGLREQVMVDCSHANSNKSHERQIDVAQDLARQLSQGEQRIIGVMVESHLEAGRQDLKPGVPLKYGVSITDACLSWSQTEPVLDVLAQAVRQRRGASRNA

SEQ ID NO: 1431 - DNA, 1074 bp, Burkholderia vietnamiensis G4
  CDS (1)..(1074): transl_table=11
atgcccccgcacaacaccgacgacgtccgcatccgcgaactcaaggaactgacgccgcccgcccacctgatccgcgaattcgcatgctccgaggccgcgtccgagctgatctacgagtcgcgccgttcgatgcaccggatcctgcacgggatggacgaccggctgatcgtcgtgatcgggccgtgctcgatccacgacacgaaggcggcgctcgaatatgcggggcggctcgtgaaggagcgggagcgcttcaagggcgagctggaaatcgtgatgcgcgtgtacttcgaaaagccgcgcacgacggtcggctggaaggggctgatcaacgatccgcatctcgacaacagcttcaagatcaacgaagggctgcgcacggcgcgcgagctgctgctgcagatcaacgagatggggctgccggccgcgaccgaatacctcgacatgatcagcccgcagtacatcgccgacctgatctcgtggggcgcgatcggcgcgcgcacgaccgagtcgcaggtgcatcgcgaactcgcgtcggggctgtcgtgcccggtcggcttcaagaacggcaccgacggcaacgtgaagatcgccgtcgacgcgatcaaggccgcgtcgcagccgcaccatttcctgtcggtgaccaagggcggccattcggcgatcgtgtcgacggccggcaacgaagactgtcacgtgatcctgcgcggcggcaagacgccgaactacgacgcggacagcgtgaacgccgcctgcgcggacatcggcaaggccggcctcgccgcgcgcctgatgatcgacgcgagccatgcgaacagctcgaagaagcacgagaaccagatcccggtgtgcgcggacatcggccgtcaggtcgccgccggcgacgagcggatcgtcggcgtgatgatcgagtcgcacctcgtcgaggggcgccaggacctgaaggaaggctgcgcgctgacctacggccagagcatcaccgacgcatgcatcgcgtgggacgacagcgtgaaggtgctcgaagggctcgcggaagcggtgaaggcgcgccgcgtcgcacgcggcagcggcaactga

SEQ ID NO: 1432 - protein, 357 aa, Burkholderia vietnamiensis G4
MPPHNTDDVRIRELKELTPPAHLIREFACSEAASELIYESRRSMHRILHGMDDRLIVVIGPCSIHDTKAALEYAGRLVKERERFKGELEIVMRVYFEKPRTTVGWKGLINDPHLDNSFKINEGLRTARELLLQINEMGLPAATEYLDMISPQYIADLISWGAIGARTTESQVHRELASGLSCPVGFKNGTDGNVKIAVDAIKAASQPHHFLSVTKGGHSAIVSTAGNEDCHVILRGGKTPNYDADSVNAACADIGKAGLAARLMIDASHANSSKKHENQIPVCADIGRQVAAGDERIVGVMIESHLVEGRQDLKEGCALTYGQSITDACIAWDDSVKVLEGLAEAVKARRVARGSGN

SEQ ID NO: 1433 - DNA, 1071 bp, Prosthecochloris aestuarii DSM 271
  CDS (1)..(1071): transl_table=11
atgcagcaattacaggatttacgtgtttcaaacattactcgactgactgcaccgcaaaccttcaagcaacgccttccggtgacggaagagattgccagaacggttttagacggtcgcgaggaagttgaaaatattttatccggaaaagattcccggatgcttgttatcgtcggtccgtgttcgattcacgatatcaaggcggcaatggagtatgccgttcgactcaaggctctgcgcgatgaactgaaggatgatctttgtatcgtcatgcgtgtttatttcgagaaaccaaggacaacgatcggctggaaagggtttatcaacgacccgcacctcgatggttcatttgatatcgagcatggattgcattatgcccgcaaactgcttcttgatatcaatgccctggggcttcctacagctacggagtttctcgatccgtttacacctcagtatgtatctgatcttgtcagctgggcggcgattggagcaagaaccatcgagtctcagacacatcgtcagatggccagcggcctgtcgatgccggtagggttcaagaactccaccgatggtcgtattcaggctgccattgatgcattacggtcggccatgcatgctcacagttttcttggtatcgatcaggaggggcacagcagtgtcatcaccacgacgggcaatccgtttggccatattgtgctgcgtggcggttcccagaagccgaactacgatccggacaatattgccgacgctgagcggaggctgcaggcagcacatctgccatctgccattatggttgattgcagtcatgccaattcggggaaaaagcatgaacagcaggccaacgtctgggataatattgtcgaacagcgcgtcaacggtacgacaagtatcatcggcgtgatgatcgaaagtaatctgttctgcggaaatcagccttttcctgacgatccatcttccctgcagtacggtgtttcgattaccgatgcctgcattgcatggaatgaaactgagacgctcttaaggaaaggcgcggtgagacttcatgaagtgcttcgaaaatctgagctttcttaa

SEQ ID NO: 1434 - protein, 356 aa, Prosthecochloris aestuarii DSM 271
MQQLQDLRVSNITRLTAPQTFKQRLPVTEEIARTVLDGREEVENILSGKDSRMLVIVGPCSIHDIKAAMEYAVRLKALRDELKDDLCIVMRVYFEKPRTTIGWKGFINDPHLDGSFDIEHGLHYARKLLLDINALGLPTATEFLDPFTPQYVSDLVSWAAIGARTIESQTHRQMASGLSMPVGFKNSTDGRIQAAIDALRSAMHAHSFLGIDQEGHSSVITTTGNPFGHIVLRGGSQKPNYDPDNIADAERRLQAAHLPSAIMVDCSHANSGKKHEQQANVWDNIVEQRVNGTTSIIGVMIESNLFCGNQPFPDDPSSLQYGVSITDACIAWNETETLLRKGAVRLHEVLRKSELS

SEQ ID NO: 1435 - DNA, 1164 bp, Xylella fastidiosa Dixon
  CDS (1)..(1164): transl_table=11
atgtgtttggcggcttttttattgtctcctccgcttggtctatgtctaaatgttctgagattacatcccatgccaccatttaccgacgacctccgtatccgaaaaattgaaccactgacacctcctaacaagctcctcttgcaactaccatgcgatgagcaggcatcgctgactgttgcgacctcacgcaacgcactgcacgatatcctgcacggccacaacgaccgtttagccgtcgtgataggcccatgctcaatccatgatccaattgcagccattgattacgcgcaacgtctgcacccattgcgagagatgtacaaggatgcactagagatcgtgatgcgggtttactttcagaaaccgcgcaccactattggttggaaaggattggtcaacgatccggatcttgatggcagcttccagatcaataagggcttgcatatcgcgcgcaacctgctgcgcgatatcaatcatctcggcttacccgccggtgtggaatttctagacacgatttcgccgcaatatctggctgacttagtcgcctggggtgccattggtgcacgcaccactgagagccaaatacaccgtgaaatggcttcaggtttatcgtgcccgattggctttaaaaacagtaccagtggtgatgtgaagattgctgctgacgcgattaaagcagcttcgcatccgcaccatttcctttcagtgacaaagacaggtgttgccgcagtcgtcgccacccagggtaaccccgattgtcacgtgattctgcgtggaggcaaggtcccgaattatgacgcaatcaatgtcgaagctgccagccaaacattgcttaaatccaagctaccggtgcgactgatgattgatgcgagccatgccaatagcggcaaaaatccaaacaatcaacctaaggtgatcgagaacatcgtagaacagcttaaagccggtgaacgccgcatcatcggtgtcatgattgaaagccaccttgttggtggtcggcaagaattagtccttggaaacacacttacctatggacagagcattaccgatgcttgcatcgactgggatacctcggtcgcaatgttagaacagctcgctcaggccgtacgcgtcagacagactctaccaacgaccgctacagctaacaaaacatcaaaaacccaataa

SEQ ID NO: 1436 - protein, 387 aa, Xylella fastidiosa Dixon
MCLAAFLLSPPLGLCLNVLRLHPMPPFTDDLRIRKIEPLTPPNKLLLQLPCDEQASLTVATSRNALHDILHGHNDRLAVVIGPCSIHDPIAAIDYAQRLHPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGKVPNYDAINVEAASQTLLKSKLPVRLMIDASHANSGKNPNNQPKVIENIVEQLKAGERRIIGVMIESHLVGGRQELVLGNTLTYGQSITDACIDWDTSVAMLEQLAQAVRVRQTLPTTATANKTSKTQ

SEQ ID NO: 1437 - DNA, 1164 bp, Xylella fastidiosa Ann-1
  CDS (1)..(1164): transl_table=11
atgtgtttggcggcttttttattgtctcctccgcttggtctatgtctaaatgttctgagattacatcccatgccaccatttaccgacgacctccgtatccgaaaaattgaaccactgacacctcctaacaagctcctcttgcaactaccatgcgatgagcaggcatcgctgactgttgcaacctcacgcaacgcactgcacgatatcctgcacggccacaatggccgtttagccgtcgtgataggcccatgctcaatccatgatccaattgcagccattgattactcgcaacgtctacgcccattgcgtgagatgtacaaggatgcactagagatcgtgatgcgagtttactttcagaaaccgcgcaccactattggttggaaaggattggtcaacgatccggatcttgatggcagcttccagatcaataagggcttgcatatcgcgcgcaacctgctgcgcgatatcaatcatctcggcttacccgctggtgtggaatttctagacacgatttcgccgcaatatctggctgacttagtcgcctggggtgccattggtgctcgcaccactgaaagccaaatacaccgtgaaatggcttcaggtttatcgtgcccgattggctttaaaaacagtaccagtggtgatgtgaagattgctgctgacgcgattaaagcagcttcgcatccgcaccatttcctttcagtgacaaagacaggtgttgccgcagtcgtcgccacccagggtaaccccgattgtcacgtgattctgcgtggaggcaaggtcccgaattacgacgcaatcaatgtcgaagctgccagccaaacattgcttaaatccaagctaccggtgcgactgatgattgatgcgagccatgccaatagcggcaaaaatccaaacaatcaacctaaggtgatcgagaacatcgtagaacagcttaaagccggtgaacgccgcatcatcggtgtcatgattgaaagccacattgttggtggccggcaagaattagtccttggaaacacacttacctatggacagagcattaccgatgcttgcatcgactgggatacctcggtcgcaatgttagaacagctcgctcaggccgtacgcgtcagacagactctaccaacgaccgctacagctaacaaaacatcaaaaacccaataa

SEQ ID NO: 1438 - protein, 387 aa, Xylella fastidiosa Ann-1
MCLAAFLLSPPLGLCLNVLRLHPMPPFTDDLRIRKIEPLTPPNKLLLQLPCDEQASLTVATSRNALHDILHGHNGRLAVVIGPCSIHDPIAAIDYSQRLRPLREMYKDALEIVMRVYFQKPRTTIGWKGLVNDPDLDGSFQINKGLHIARNLLRDINHLGLPAGVEFLDTISPQYLADLVAWGAIGARTTESQIHREMASGLSCPIGFKNSTSGDVKIAADAIKAASHPHHFLSVTKTGVAAVVATQGNPDCHVILRGGKVPNYDAINVEAASQTLLKSKLPVRLMIDASHANSGKNPNNQPKVIENIVEQLKAGERRIIGVMIESHIVGGRQELVLGNTLTYGQSITDACIDWDTSVAMLEQLAQAVRVRQTLPTTATANKTSKTQ

SEQ ID NO: 1439 - DNA, 1074 bp, Prochlorococcus marinus str. MIT 9211
  CDS (1)..(1074): transl_table=11
atggtcatttctccagatcttaatttgttcgataaaacttctgatcttcatattgttgagactagacctttggtctcaccttctttgttgcatcatgacttaccgctggatttaaaagctgcagaaattgttgctcaaactcgtaaacggattcaagcaatccttgctggggatgattcacgtttattagtgatagtaggaccttgctcagttcatgatgtaagtgcagctaaggaatacgctaagaaacttattcctttaagagaacgtttttcagatgcactggaaattgtgatgagagtttattttgaaaaacctagaacaactattggatggaaagggcttataaatgatccgcatttagatggatcatacgatatcaatacaggcttaagacgggcaagagccttacttttagatttagcccggtctgggatgccagcagcaacagaactattagatcccatagtgcctcaatatattgcagatttgattagttggactgctattggtgcaagaactacagaaagtcaaactcatagagaaatggcttcaggtttatccatgcctataggttataagaatgggacggatggaactgtagctattgcaattaatgcaatgcaggcagcatcaagggctcatcattttttaggcattaatcacaaaggttttgcttcaataatcagcacaacaggtaatcctgatggtcatcttgttttgcgaggtggtagtagtggcactaattatcacgttgaatctgttttgaatgcagcgaaagagctttctaaggcatctttaggtgacaaagtaatgattgattgcagtcatggcaactctaataaagattttcggcaacaatcacatgttcttcgagaagtatctaagcagattaaagaaggtttctctcatgtaatgggagttatgcttgaaagtcatcttgtagaaggtaatcaaaagttagtagcagatctttcacaattgaagtatggccaaagtattactgatgcatgtatagatataaaggctacggaaagtcttttagaagagcttgcagtttctatgagggcatag

SEQ ID NO: 1440 - protein, 357 aa, Prochlorococcus marinus str. MIT 9211
MVISPDLNLFDKTSDLHIVETRPLVSPSLLHHDLPLDLKAAEIVAQTRKRIQAILAGDDSRLLVIVGPCSVHDVSAAKEYAKKLIPLRERFSDALEIVMRVYFEKPRTTIGWKGLINDPHLDGSYDINTGLRRARALLLDLARSGMPAATELLDPIVPQYIADLISWTAIGARTTESQTHREMASGLSMPIGYKNGTDGTVAIAINAMQAASRAHHFLGINHKGFASIISTTGNPDGHLVLRGGSSGTNYHVESVLNAAKELSKASLGDKVMIDCSHGNSNKDFRQQSHVLREVSKQIKEGFSHVMGVMLESHLVEGNQKLVADLSQLKYGQSITDACIDIKATESLLEELAVSMRA

SEQ ID NO: 1441 - DNA, 1089 bp, Synechococcus sp. RS9917
  CDS (1)..(1089): transl_table=11
atgaccaccacctccgatctgcatgtggtggagaaccgcccactggtggctccagctctgttgcatgcggatctcagaaccgatgcggcggccacagccacggtggcgggcacccgcaggaccattcagtccatcctccgcggcgacgatcagcgactgctggtgatcgtcggcccctgctcggtgcacgatgtggaggcggcgcgggagtacgcgtgtcgtctggcgccgctgcgcgagcggcatgccgccgaactggaagtggtgatgcgggtgtatttcgagaaaccgcgtaccaccgtgggttggaaagggctgatcaatgacccgcacctcgatggctcttacgacatcaacaccggcctgcgtctggcgcgcgctctgctgctcgacctggcccgcgccggcatgccggcggccacggagctgctcgatccggtggtgccccaatacatcgccgacctgatcagctggacggccatcggcgcccggaccaccgaaagccagacccaccgcgagatggcctcaggtctgtcgatgccggttggctacaaaaacagcaccgatggcagtgtcaccatcgccattcacgcgatccaggcggcatccaggccccatcattttctgggcatcaacgggcagggcattgcctcgatcgtgagcaccaccggcaacccggatggccatctcgtgctgcgaggcggcagccggggaaccaactatcacctggatgcggtgcaggagtcggcggcggccctggcggcggcaggcctgcccgatcgtttgatggtggattgcagccatggcaattccaacaaggattaccggcgccagggtgaggtgctggaggcggtggctgcccaggtgcggcagggttccgaccatgtgatgggcgtgatgctggagagccatctggtggaaggcaaccagaagctcaatgccgatcgcacggcgatgacctacggccagagcatcaccgatgcctgcatcagcatcgacaccaccgaaagcttgctggagcagttggcagcggcggtggcggcgggccggccgttggcactctcgcggcaagagtgccagcttgcttga

SEQ ID NO: 1442 - protein, 362 aa, Synechococcus sp. RS9917
MTTTSDLHVVENRPLVAPALLHADLRTDAAATATVAGTRRTIQSILRGDDQRLLVIVGPCSVHDVEAAREYACRLAPLRERHAAELEVVMRVYFEKPRTTVGWKGLINDPHLDGSYDINTGLRLARALLLDLARAGMPAATELLDPVVPQYIADLISWTAIGARTTESQTHREMASGLSMPVGYKNSTDGSVTIAIHAIQAASRPHHFLGINGQGIASIVSTTGNPDGHLVLRGGSRGTNYHLDAVQESAAALAAAGLPDRLMVDCSHGNSNKDYRRQGEVLEAVAAQVRQGSDHVMGVMLESHLVEGNQKLNADRTAMTYGQSITDACISIDTTESLLEQLAAAVAAGRPLALSRQECQLA

SEQ ID NO: 1443 - DNA, 1074 bp, Synechococcus sp. WH 5701
  CDS (1)..(1074): transl_table=11
atgctcaccacctccgacctccacatcgtggagacacggccgctggtggcaccggcggttctccatcgcgaactgcccctgagccagacggcggcccgcaccgtgcttgacgcccgtgagcggatcaaggcgattctgcatgggcaggattcccgcctgctggtgatcgtcggtccctgctcggtgcacgacgtggaggccgccagagcctatgccgatgccatcgccgaggtgcgtgagcgccaccgcgaccagctggaggtggtgatgcgggtgtacttcgagaagccccgcaccaccgtgggctggaagggcctgatcaacgatccccacctcgacggcagctacgacatcaacaccggcctgcgcctggcgcggggcctgctggtgcacctggccgagatggggctgcccgccgcaaccgagctgctcgatccggtggtgccccagtacatcgccgacctgatcggctggacagcgatcggggcgcgcaccaccgaaagccagacccaccgggagatggcctcgggcctgtcgatgccgatcggcttcaagaacggcaccgacggcagcgccgtcacggccatccatgccatgcaggccgcctccaagccccaccatttcctgggcatcagccagctgggccatgccgcgatcgtctccaccaccggcaaccccgatggccatctggtgctgcgcggcggtaagggaggcaccaattaccacccggaggcgatcgagcaggcggcccttgcgctgcagaaggagggtctcccggcgaggctgatggtcgactgcagtcacggcaactccaacaaggactaccggcgccagggggaggtgctcgccgaggtggccggccaggtgcgcggtgggtccagccatgtgatgggggtgatgatcgaaagtcacctggtggccggcaatcagaagatcccagccgatctgagccagctcgcttacggccagagcatcaccgatgcctgcatcgacctggagaccacccgcacggtccttgacggtctggccgaagccgtggcagaggcccaggccgccaacctggcgccggtctga

SEQ ID NO: 1444 - protein, 357 aa, Synechococcus sp. WH 5701
MLTTSDLHIVETRPLVAPAVLHRELPLSQTAARTVLDARERIKAILHGQDSRLLVIVGPCSVHDVEAARAYADAIAEVRERHRDQLEVVMRVYFEKPRTTVGWKGLINDPHLDGSYDINTGLRLARGLLVHLAEMGLPAATELLDPVVPQYIADLIGWTAIGARTTESQTHREMASGLSMPIGFKNGTDGSAVTAIHAMQAASKPHHFLGISQLGHAAIVSTTGNPDGHLVLRGGKGGTNYHPEAIEQAALALQKEGLPARLMVDCSHGNSNKDYRRQGEVLAEVAGQVRGGSSHVMGVMIESHLVAGNQKIPADLSQLAYGQSITDACIDLETTRTVLDGLAEAVAEAQAANLAPV

SEQ ID NO: 1445 - DNA, 1065 bp, Synechococcus sp. WH 7805
  CDS (1)..(1065): transl_table=11
atgaccaccacacacgaccttcatgtggtggacaccaggcctctggttcctcccgccttgctgcatggagatctgccgattgatgccagggcgacggagaccgtggccacctcgcgcagccgaattcaagccattctcaggggtctggaccggcgactgctggtgatcgtcggcccctgctctattcatgatgtggatgcagcgagggagtacgccagcaaactggctcccctgcgtgaacgtcatgcctctgagctcgaggtggtgatgcgtgtgtacttcgagaagccacgcaccacggtgggatggaagggcctcatcaatgatccgaacctcgacggctcctacgacatcaacacggggttgcgaatggctcggtcgttactgctcgatttggccagggatggaatgccctgtgccactgaactgctcgatcctgtagttcctcagtacatcgctgatctgatcagttggacggcgatcggcgcccgtaccaccgaaagccagacgcaccgcgaaatggcttcaggcttgtcgatgccgatcggctacaaaaacagcaccgacggcagtgccaccattgccatcaacgccatgcaggccgcgtccaaaccccatcattttcttgggatcaatcgcgaggggcatgcatcgatcgtgagcaccaccggaaatccggatggtcatctggtgctgcggggagggaaccgaggcacgaattaccatctcgaggcgattcaggatgctgctgaagaattgaaagcagcgggactacccgaccggttgatggtcgattgcagtcatggcaactccaacaaggattatcgccggcaaggtgatgtgttgaaagctgtggcagctcaggtggaacaggggtcagcgcatgtgatgggtctgatgctcgaaagccatcttgttgagggcaaccaaaagatcagttcggatcgttcagcactgacccatggccaaagcgtcacggacgcatgcatcagcattgagacgacagcggagctgctggagggtttggctgattcgctgaagaaagttggcactcgtgttgcttga

SEQ ID NO: 1446 - protein, 354 aa, Synechococcus sp. WH 7805
MTTTHDLHVVDTRPLVPPALLHGDLPIDARATETVATSRSRIQAILRGLDRRLLVIVGPCSIHDVDAAREYASKLAPLRERHASELEVVMRVYFEKPRTTVGWKGLINDPNLDGSYDINTGLRMARSLLLDLARDGMPCATELLDPVVPQYIADLISWTAIGARTTESQTHREMASGLSMPIGYKNSTDGSATIAINAMQAASKPHHFLGINREGHASIVSTTGNPDGHLVLRGGNRGTNYHLEAIQDAAEELKAAGLPDRLMVDCSHGNSNKDYRRQGDVLKAVAAQVEQGSAHVMGLMLESHLVEGNQKISSDRSALTHGQSVTDACISIETTAELLEGLADSLKKVGTRVA

SEQ ID NO: 1447 - DNA, 1059 bp, Photobacterium sp. SKA34
  CDS (1)..(1059): transl_table=11
atgccaatgaaaacagatgaacttcgcaccgtgagtttaggcttgatgccaactccagctgaaattgaagcaacatcaccaatgactgatgaaattgcggcgcatgtagatcactcccgcaaacagattgaggcgattttaacgggtcaagattcccgtttactggtgattgttggaccatgttctatacatgataccgatgcagcagttgattatgcgaaacgccttgttgctgtacaagaaacatataaagaccaattgtttatcgtaatgcgtacctatttcgaaaaaccacgtaccgtggtcggctggaaaggtttagttacggatcctcatttagatggcagtttagacttagtaactggtttagaaaaagcacgcaaactattaattgatattaactcactaggcttacccactgcgactgaattcctcgatatgatcactggtcaataccttgctgatcttatcagttggggtgccattggtgcgcgtactacagaatctcagatccaccgtgaaatggcatcagcactgtcttgccctgttggctttaaaaacggcacagacggtaatacaaaaattgcgattgatgctattcgcgccactcgtgaatctcaccttttctgttcaccggcaaaaaatggacaaatgacgatttaccgtacttccggtaacccttacggtcatattattttacgtggcggtaagatgccaaattatcacgctgaagacgtcgcaacagcatgtgaggcattagccgagtttgaattaccacagagattaattgtcgattttagtcatggcaactgccaaaaacagcataaacgtcaattagatgtcacagctgaaatttgtgaacaattaaaaaatagtagccagtctattgcgggtatcatggcagaaagctttattgaagaagggaatcaagcagttattgaaaacaaacttgatgagcttgtttacggtaaatctattactgacccttgtattcactggaacgacacgcttaagatgctcgatatgctagcggatgccgttaaaacagcacaacgctaa

SEQ ID NO: 1448 - protein, 352 aa, Photobacterium sp. SKA34
MPMKTDELRTVSLGLMPTPAEIEATSPMTDEIAAHVDHSRKQIEAILTGQDSRLLVIVGPCSIHDTDAAVDYAKRLVAVQETYKDQLFIVMRTYFEKPRTVVGWKGLVTDPHLDGSLDLVTGLEKARKLLIDINSLGLPTATEFLDMITGQYLADLISWGAIGARTTESQIHREMASALSCPVGFKNGTDGNTKIAIDAIRATRESHLFCSPAKNGQMTIYRTSGNPYGHIILRGGKMPNYHAEDVATACEALAEFELPQRLIVDFSHGNCQKQHKRQLDVTAEICEQLKNSSQSIAGIMAESFIEEGNQAVIENKLDELVYGKSITDPCIHWNDTLKMLDMLADAVKTAQR

SEQ ID NO: 1449 - DNA, 1071 bp, Photobacterium sp. SKA34
  CDS (1)..(1071): transl_table=11
atgcaaaaagaccaactcaataacgttcatatcgaagatgaatctgttcttattacgccagcaaagttgaaacaagacttatctgtctctaaacaagcgttgtcttttgtggagcaatcacgtcaaaccatcgcagatattattcataagcgcgatcatcgtttattggtcgtgtgtgggccttgttctattcatgatgttgagcaagcaaaagcttacggacataagttaaagctattagcagaagagcttagcgatcaactctatattgttatgcgagtttattttgaaaagccacgcactactgtggggtggaaaggtttaattaacgacccatatattaatggttcatttgctgttgaagaaggcttgcatattggtcgtcagctattagtcgacttagtggaagatggtattcctttagcgaccgaagcacttgatcccattagtccgcaatatttaggtgatttatttagttgggctgcaattggtgcgcgtacgacagagtcacaaacccaccgtgaaatggcaagtggactatcaatgcctgtaggctttaaaaatggtactgatggtagcttggcaacagcgattaatgcgatgcaagcggctgcgtcaggccataaatttatgggaattaaccctgatgggcaagttgctctgctaaatactgaaggtaatcctgatggtcatgttattttacgtggcggtaagcaaactaattacgattcagtgtcagttagagagtgtgaaaacgagatggtcggatccggtctttcaccagccttaatggtagactgtagccacgctaattctcgtaaagattatcgtcgccagcctttggtagctgaagatgtaattcatcagatccgcgaaggaaatcagtctattataggattgatgatcgaaagccaccttgatgaagggaaccagagtgccgatcttcctcgagatgaaatgaagtacggtgtatcgataactgatgcatgtattggttgggacaccactgagaaactactgcgtcaggcacataaggaattagtgccgttcttacaagatcgaattaaataa

SEQ ID NO: 1450 - protein, 356 aa, Photobacterium sp. SKA34
MQKDQLNNVHIEDESVLITPAKLKQDLSVSKQALSFVEQSRQTIADIIHKRDHRLLVVCGPCSIHDVEQAKAYGHKLKLLAEELSDQLYIVMRVYFEKPRTTVGWKGLINDPYINGSFAVEEGLHIGRQLLVDLVEDGIPLATEALDPISPQYLGDLFSWAAIGARTTESQTHREMASGLSMPVGFKNGTDGSLATAINAMQAAASGHKFMGINPDGQVALLNTEGNPDGHVILRGGKQTNYDSVSVRECENEMVGSGLSPALMVDCSHANSRKDYRRQPLVAEDVIHQIREGNQSIIGLMIESHLDEGNQSADLPRDEMKYGVSITDACIGWDTTEKLLRQAHKELVPFLQDRIK

SEQ ID NO: 1451 - DNA, 1068 bp, Oceanospirillum sp. MED92
  CDS (1)..(1068): transl_table=11
atgacagatacacgcgtagaagatttaaacatcgaatcaaacacccccctggtatcacccgatgcccttaaagcagaaatgcctatttctgaagcagctgctgaagctgttatgcaaggccgcgctgtaatacgcgatattttagatcgcaaagacccgcgccttttcgttgttgtaggcccatgctctattcacgatactgaagcagctattgcctatggcaagaagctacaagcgcttcaggaaaaggttaaagattcgctctatcttgtcatgcgtgtgtattttgaaaagccaaggacgaccgtaggctggaaaggtctgattaacgacccacacctaaacgactcttttgaaatcgaagagggcctgcacattgcgcgtaagctgctgatcgatctatctgaaatgggattaccgctcgctacagaagcacttgatccgatctctccgcagtacatgcaggacctgatctcctggtctgctattggcgcacgtaccaccgagtcacaaacacaccgtgagatgtcttctgggctgtcatgcgcagtaggattcaaaaacggtactgatggtggtcttgatgttgctacaaacgccctgaaatctgtgagcgcccctcaccgcttccttggtatcaatgaagagggtcaggtttctattgttcacactaaaggtaaccagtatggccatgttgtactgcgtggcggtggcggaaagccgaattacgattcagtaaatgttgcactttgtgagcaggcgcttgataaagcaggcctggcaaacaacatcatgattgattgcagtcatgcaaactcaagtaaagaccctgcccttcagccgctggttgctgagaatgccgcaaaccagattattgaaggcaacaaatctatcgttggtctgatgattgaaagtaacctgggctggggtaatcagtctattccggataaccttgaagatctggaatatggcgtatccgttactgatgcatgtattgactgggatactaccgagaagtgcctggttgagatgaatgaaaaactaaaagacgcgctgaaaagccgttaa

SEQ ID NO: 1452 - protein, 355 aa, Oceanospirillum sp. MED92
MTDTRVEDLNIESNTPLVSPDALKAEMPISEAAAEAVMQGRAVIRDILDRKDPRLFVVVGPCSIHDTEAAIAYGKKLQALQEKVKDSLYLVMRVYFEKPRTTVGWKGLINDPHLNDSFEIEEGLHIARKLLIDLSEMGLPLATEALDPISPQYMQDLISWSAIGARTTESQTHREMSSGLSCAVGFKNGTDGGLDVATNALKSVSAPHRFLGINEEGQVSIVHTKGNQYGHVVLRGGGGKPNYDSVNVALCEQALDKAGLANNIMIDCSHANSSKDPALQPLVAENAANQIIEGNKSIVGLMIESNLGWGNQSIPDNLEDLEYGVSVTDACIDWDTTEKCLVEMNEKLKDALKSR

SEQ ID NO: 1453 - DNA, 1068 bp, marine gamma proteobacterium HTCC2207
  CDS (1)..(1068): transl_table=11
atggattcacaggctgtagaaaatattaatatcgaaccaccagtggttctgattaccccagcggaattgaagagtgaaatcccgctgagtgacaaagcccgagaggtcatctctaagggtcgtaaaaatatcgagaacatactagagcgcaaagatcatcgcctaatggttgtagtgggtccctgctctatccacgatcttaaggccgctcatgactatgccaacagactcaaagccctagaagagaaagtcggcgatacactgctgattgttatgcgcgtgtattttgaaaagccccgcaccaccaccggttggaaaggcttgatcaacgatccatttatgaatgactcatttaagattaccgatggtctgcatattggtcgtcagctgctgcacgatattttggaaattggcctgcccactgccaccgaagcactggatcccatttcacctcagtatctgcaagacttgatagcctggtcggcgattggtgcacgcaccacagaatctcagactcaccgagagatggcctctggcctgtcctcgtctattggttttaaaaatggtaccgatggcagcttgaccgtagccatcaatgccttgcagtcagtttcaagcccacaccgttttttaggcattaattcagacggcaatgtctcgattgttacgactaaaggcaatccctacgcccatgtcgttttgcgcggcggcaatggcaagcctaactatgattcggttagcgtttcaatttgcgagcaggagctcgttgccgccggtatcgatgccaatatcatggttgactgcagtcacgccaattccaataaagaccacaatctgcagcctttggtgctggataatgttgccaaccagatcgtcgaaggcaataagtcaattattggtgtgatgctggagagtaatatcaatgcgggtaatcagaagctctcaagtaatccagatgatatggactacggtgtctcagtaactgatgcctgtatcgactgggaaaccacggaaagaacattgatctcaatggcagataaattacgcgatgttttaaaaacccgctaa

SEQ ID NO: 1454 - protein, 355 aa, marine gamma proteobacterium HTCC2207
MDSQAVENINIEPPVVLITPAELKSEIPLSDKAREVISKGRKNIENILERKDHRLMVVVGPCSIHDLKAAHDYANRLKALEEKVGDTLLIVMRVYFEKPRTTTGWKGLINDPFMNDSFKITDGLHIGRQLLHDILEIGLPTATEALDPISPQYLQDLIAWSAIGARTTESQTHREMASGLSSSIGFKNGTDGSLTVAINALQSVSSPHRFLGINSDGNVSIVTTKGNPYAHVVLRGGNGKPNYDSVSVSICEQELVAAGIDANIMVDCSHANSNKDHNLQPLVLDNVANQIVEGNKSIIGVMLESNINAGNQKLSSNPDDMDYGVSVTDACIDWETTERTLISMADKLRDVLKTR

SEQ ID NO: 1455 - DNA, 1227 bp, Mycobacterium sp. JLS
  CDS (1)..(1227): transl_table=11
gtgtgcgtgccagctattggcgctttatcaaggctccgggcggagccgataaagcgcagcgctaagcacgcatccacccggagcccaggcagtgaccacacggtcgctgcctttcgtcattcaagggcaccggaccgtcacgcaggtgcccatccccagaaaggcacctcgagaatgaacctggcgcagatcgccaccccgccggccacctccgaccggcgcatccgcagcttcagcgcgattcccagcccgcacgaggtgctcgcggagttcccgctgggtgcccggcgcgccgagcgggtggcccgcgaccgcaccgagatcgccgacatcctcgccggccgcgacgaccgactgctggtcgtggtcggtccgtgctcggtgcacgatccggtcgccgcgctggactacgcaagccggctcgcgaagatcgccgacgaactcggcgaccggctcaagatcgtcatgcgcgtgtacttcgagaagccgcggacgacgatcggatggaaggggctgatcaacgatccggggatggacggcacgttcgatgtgtcgcgcggtctgcgcaccgcccgccagctgctgctcgacatcatcgacatcggcctacccgtcggatgcgagttcctggaaccgaccagcccgcagtacatcgccgacgccgtcgcctggggtgccatcggcgcccgcacgaccgaatcgcaggtgcaccgccaactcgcgtcgggtctgtcgatgcccgtcggcttcaagaacggcaccgacggcaacatccaggtggccgtcgacggggtgaaggccgccgcggcccagcacgtcttcttcgggatggacgactccggccgtggcgcggtcgtgagcaccgagggcaacgaggactgccacgtcatcctgcgcggcggtaccgacggacccaactacgacgcggatgccgtgcaggccgccgccgccaagctgaccgccgccggactgccgggacgggtcgtcgtcgactgcagccacgccaactccggcaaggaccacgtccgccaggcggcggtggccgccgaggtggcccagctgatccgcgaggggcttccggtcagtggggtgatgctggagagcttcctggtcgggggtgcgcagtccgccgagtcgcggccgctcacctacgggcaatcggtcaccgacaaatgcatggactggaccgcgacggatctggtgctgcgagaactggcggcgcgctag

SEQ ID NO: 1456 - protein, 408 aa, Mycobacterium sp. JLS
MCVPAIGALSRLRAEPIKRSAKHASTRSPGSDHTVAAFRHSRAPDRHAGAHPQKGTSRMNLAQIATPPATSDRRIRSFSAIPSPHEVLAEFPLGARRAERVARDRTEIADILAGRDDRLLVVVGPCSVHDPVAALDYASRLAKIADELGDRLKIVMRVYFEKPRTTIGWKGLINDPGMDGTFDVSRGLRTARQLLLDIIDIGLPVGCEFLEPTSPQYIADAVAWGAIGARTTESQVHRQLASGLSMPVGFKNGTDGNIQVAVDGVKAAAAQHVFFGMDDSGRGAVVSTEGNEDCHVILRGGTDGPNYDADAVQAAAAKLTAAGLPGRVVVDCSHANSGKDHVRQAAVAAEVAQLIREGLPVSGVMLESFLVGGAQSAESRPLTYGQSVTDKCMDWTATDLVLRELAAR

SEQ ID NO: 1457 - DNA, 1053 bp, Oceanobacter sp. RED65
  CDS (1)..(1053): transl_table=11
atgcacgcacaaactgacgatttacgcattcgaaatgttaaagaattgttaccccccatcgcgttactcgaaaaattcccattgtctagtgaggcggccgatacagtagcccaggctcgtagcgacatacaatctcgtttacaaaacaaagatgatcgattacttgtgattattggtccatgttcgattcatgaccctcaagctgcacttgagtacgctgggcgcctaatccgcatgcgtgagaaatacaaagatcaattaaatatcgtcatgcgtgtgtattttgaaaagcctcgtactactgtgggctggaaaggcttaattaatgatccgtacttggataatagttttgccatcaacgatggtttgcgtttggcgcgaaagctattgttggatctcaatgatatgggcatgcccgcagcaaccgaatttctcgatatgattacgccccagtacatcgcagacttaatctgttggggagccattggtgcgcgtacgacagaatctcaagtgcatcgtgaattggcatccggtttatcctgcccagtcggttttaaaaacggtactgatggcacaagtaaaattgctttggatgccattggcgcagctgctgcttctcaccattttttatcagtgacaaagtttggtcatagtgcgattgttgaaacggaaggaaatcctgattgccacatcattttacgtggtggtaaagagccaaactatgatgaagagagcgtgacggcaattgctaaagatttagaaaagaaaaacctgccgcagaatattatggtggacttcagtcatgccaatagtcaaaagcagtttaaaaagcaaatggaagtggctacagatgttgctcgtcagatagcgaagggcgatagtccaattatgggggtgatggtggaaagtcacctagaagaaggacgtcaggatttagaagacaaaggcagtttacactatggtcaaagcatcactgatgcatgtatcggttggccagatacggaagagctgttggcgacgctggcgaacgctgtagagcaatctcgtaaatag

SEQ ID NO: 1458 - protein, 350 aa, Oceanobacter sp. RED65
MHAQTDDLRIRNVKELLPPIALLEKFPLSSEAADTVAQARSDIQSRLQNKDDRLLVIIGPCSIHDPQAALEYAGRLIRMREKYKDQLNIVMRVYFEKPRTTVGWKGLINDPYLDNSFAINDGLRLARKLLLDLNDMGMPAATEFLDMITPQYIADLICWGAIGARTTESQVHRELASGLSCPVGFKNGTDGTSKIALDAIGAAAASHHFLSVTKFGHSAIVETEGNPDCHIILRGGKEPNYDEESVTAIAKDLEKKNLPQNIMVDFSHANSQKQFKKQMEVATDVARQIAKGDSPIMGVMVESHLEEGRQDLEDKGSLHYGQSITDACIGWPDTEELLATLANAVEQSRK

SEQ ID NO: 1459 - DNA, 1068 bp, Oceanobacter sp. RED65
  CDS (1)..(1068): transl_table=11
atgaccaacaatcgggttgaagatttaaatattgagcgtacagaaacgcttaccactccagaacagcttaagcaaagcttaccaatctcggaaaaggccctgcaatcagttgaggccggccgcgaggcagtaaaaaacatcttagacaggaaagaccctcgcttgtttttggtgcttggcccctgctctattcacgatgtaaaagcagcaaaagaatatgctgaacgcttaaaagatctcgcagccaaagtaagcgacactcttctgcttgtaatgagagtttatttcgagaagcctcgcaccactgttggatggaaaggattaattaatgatccgtatttaaacgacagcttcaaaattgaagatggtctccacatctcgcgcaagcttctaattgatcttgcagagcttggcctgcctctttcaaccgaagcacttgaccctatttcaccacagtatatgcaggatctaattagctggtctgctattggggcacgcacaactgagagccaaactcacagagaaatggcaagcggcctttcttgtgccgtcggattcaaaaatggaaccgatggaagcctaacggtggcgatcaatgctcttcagtccaccgccaaccctcaccgttttctggggatcaatggtgatgggcaggtaagtgtagtcaccacaaaaggtaatgagtatgggcacgtggtgctgcgcggcggcggcggcaaacctaactacgattctgttagtgttgcactctgcgagcaagaactggagaaagccggagttgccagcaatatcatggtagattgcagtcacgcaaactcaaacaaagacccaggtcttcaaccgctagttatggataatgtgacaaatcaaattctagagggaaacaagtcaatcgttggattaatgattgagtcaaatcttcaatttggcaatcaaaaaatcccctcaaatcttgacgatctagaatacggcaagtccatcactgatggatgcatttcttgggagcaaaccgaagaagctgtgttaaagatgcgcgataaattgaaagacgttattgccaagcgataa

SEQ ID NO: 1460 - protein, 355 aa, Oceanobacter sp. RED65
MTNNRVEDLNIERTETLTTPEQLKQSLPISEKALQSVEAGREAVKNILDRKDPRLFLVLGPCSIHDVKAAKEYAERLKDLAAKVSDTLLLVMRVYFEKPRTTVGWKGLINDPYLNDSFKIEDGLHISRKLLIDLAELGLPLSTEALDPISPQYMQDLISWSAIGARTTESQTHREMASGLSCAVGFKNGTDGSLTVAINALQSTANPHRFLGINGDGQVSVVTTKGNEYGHVVLRGGGGKPNYDSVSVALCEQELEKAGVASNIMVDCSHANSNKDPGLQPLVMDNVTNQILEGNKSIVGLMIESNLQFGNQKIPSNLDDLEYGKSITDGCISWEQTEEAVLKMRDKLKDVIAKR

SEQ ID NO: 1461 - DNA, 1119 bp, Acidovorax sp. JS42
  CDS (1)..(1119): transl_table=11
atgaacgcccatgtctccagcagcgatgcctggtatcccaacgtcgagaaaaccagcgagaccgacgaccaacgcatcaaggacatcaccgtgcttcctcctccagaccacctgattcgcttcttcccgatccgcgggtcggaggtggagtcgctgattgccaacacacgccgcagcatccagcgcatcatgagcggcgaggacgaccggctgctcgtcatcatcggcccctgttcgatccacgacccgcacgccgcggtggactatgcgcgcaagctcaaggccgtgcgtgagcagtacaaggatcaactggaagtggtgatgcgcgtgtacttcgagaagccccgcaccaccgtgggctggaagggcctgatcaacgacccctacctggacggcagctaccgcatcgacgagggcctgcgcatcgcgcgccagctgctcatcgacatcaaccgcctgggcgtgccggcgggcagcgagttcctggacgtgatctcgccccagtacatcggcgacctgatcagttggggcgccatcggcgcgcgcaccaccgaaagccaggtccaccgcgaactggcctccggcatttcggcccccatcggcttcaagaacggcaccgatggcaacatccgcatcgccaccgatgccatccagtccgccagccgcggccaccacttcctgtcggtgcacaagaacggccaggtggccatcgtgcacaccgcgggcaacaaggattgccacgtgatcctgcgcggcggcaaggcgcccaactacgacgcagccagcgttgccgcggcctgcaaggacctggaggccgccggcctgccggcgtcgctgatggtggactgcagccatgccaacagcagcaagcagcacgagaagcagcgcgatgtggcgcgcgacatcgccgcgcagatcgcaggcggctcgcgcagcgtgttcggcgtgatggtggaaagccacctgcagcccggagcgcagaagttcacgccgggcaaggacgatgccacgacgctggaatacggcaagagcatcaccgatgcctgcctgggatgggacgactccgttgcctgcctggccgagctggcggccgccgtgcaagcgcggcgcgcgcgttga

SEQ ID NO: 1462 - protein, 372 aa, Acidovorax sp. JS42
MNAHVSSSDAWYPNVEKTSETDDQRIKDITVLPPPDHLIRFFPIRGSEVESLIANTRRSIQRIMSGEDDRLLVIIGPCSIHDPHAAVDYARKLKAVREQYKDQLEVVMRVYFEKPRTTVGWKGLINDPYLDGSYRIDEGLRIARQLLIDINRLGVPAGSEFLDVISPQYIGDLISWGAIGARTTESQVHRELASGISAPIGFKNGTDGNIRIATDAIQSASRGHHFLSVHKNGQVAIVHTAGNKDCHVILRGGKAPNYDAASVAAACKDLEAAGLPASLMVDCSHANSSKQHEKQRDVARDIAAQIAGGSRSVFGVMVESHLQPGAQKFTPGKDDATTLEYGKSITDACLGWDDSVACLAELAAAVQARRAR

SEQ ID NO: 1463 - DNA, 1101 bp, Acidovorax sp. JS42
  CDS (1)..(1101): transl_table=11
atgaccctgaccgaacgcctcgcatccccgctcaccacccacgacaccacgcgcatcgacgacctgcgcatcaaagccgtgcgcccgctcatcacgcccgcgctgctgcaggaatggcagcccgcgcccgaggcggcgcagacgctggtggaaagcagccgcgtggccatctcgcgcgtgctgcacgggcaggacgaccgcctcatcgtcgtggtggggccgtgctccatccacgaccatgaccaggccatggagtacgcgcgcctgttgaaggagcaggcggatgcgttggcgcaggacctgctcatcgtgatgcgcgtgtacttcgagaagccccgcaccaccgtgggctggaagggctacatcaacgacccgcacctggacggcagcttcgccatcaacgaaggcctggagcgcgcccgcgcattgctgctggacgtgctggcgctgggcctgcccgtgggcacggaattcctggacctgctgtcgccgcagttcatcagcgacctggtgagctggggcgccatcggcgcgcgcaccaccgaaagccagagccaccggcaactggccagcggcctgtcctgccccgtgggcttcaagaacggcacggatggcggcgtgaaggtggcggccgacgccatccaggccgcgcaggcaccgcatgccttcatgggtatgacaaagatggggcaggcggcgatcttcgagacgcgcggcaaccacgactgccatgtgatcctgcgcggcggcaagaccccgaactacggcgcggccgacgtgcaggccgcctgcgagatgctggagaaggccggccagcgcccgcaggtgatgatcgacctgtcgcatgccaacagcagcaagcagcaccgccgccagatcgacgtggcgcaggacgtggcccagcagatcgccgccggcgatgcacgcatcaccggcgtgatgatcgagagccacctgcaggagggccgccaggacatcgtggacggccagccgctcacacccggcgtgtcggtcaccgacgcctgcatcagcttcgcacagaccgtgccggtactgcagcagctggctgcggccgtgcgcgaacgccgcacgcgcggctga

SEQ ID NO: 1464 - protein, 366 aa, Acidovorax sp. JS42
MTLTERLASPLTTHDTTRIDDLRIKAVRPLITPALLQEWQPAPEAAQTLVESSRVAISRVLHGQDDRLIVVVGPCSIHDHDQAMEYARLLKEQADALAQDLLIVMRVYFEKPRTTVGWKGYINDPHLDGSFAINEGLERARALLLDVLALGLPVGTEFLDLLSPQFISDLVSWGAIGARTTESQSHRQLASGLSCPVGFKNGTDGGVKVAADAIQAAQAPHAFMGMTKMGQAAIFETRGNHDCHVILRGGKTPNYGAADVQAACEMLEKAGQRPQVMIDLSHANSSKQHRRQIDVAQDVAQQIAAGDARITGVMIESHLQEGRQDIVDGQPLTPGVSVTDACISFAQTVPVLQQLAAAVRERRTRG

SEQ ID NO: 1465 - DNA, 1062 bp, Synechococcus sp. RS9916
  CDS (1)..(1062): transl_table=11
atgaccaccacttccgatctccatgtggtggagacccgtcccctgctcgctcccgctctgttgcatgcggatctgccgattgaccctggagcggcggatacggtggccggcgcccgccgccggattcaatccatcctcagcggtgaagatcgccgcatgctggtgatcgtcggtccttgttccgtgcacgacgtggaggcggcacgggagtacgcccgtcgtctggcaccgctgcgcgaacgccacatcaacgagctggaagtggtgatgcgggtctatttcgagaagccccgcaccacggtgggctggaagggtctgatcaatgacccccacctcgatggctcttacgacatcaataccgggctgcgtctgtcccgttcattgctgctggatctggcccgcgatggcatgcccaccgccacggagctgctcgacccagtggttccccaatacatcgccgacttgatcagctggaccgccatcggcgcccgcaccacggaaagccagacccaccgggagatggcatctgggctttcgatgccgatcggctacaagaacagcaccgatggcagcgccaccatcgccatcaatgcgatgcaggcggcctccaagccccaccatttcctgggcatcaaccacagcggtcaggcctcgatcgtgagcaccaccggcaatccccatggccatctggtgctgcgtggtggcaatcgcggcaccaatttccatctggaggcggtggaatctgcggcagccgagctggcgaatgccggtctggtggatcgcttgatggtggattgcagccatggcaattccaacaaggactatcgccgccagggcgaagtgctgcaggcggtcgctgagcaagtgcagcagggctccacccatttaatgggcgtgatgctggagagccatctggtggaaggcaaccagaagctcaatgctgatcgtgcggcgatgacctacggccagagcgtgaccgacgcttgcatcagcctcgacaccacggctgggctgctggagcagctggcttctgcggttgccgctgcgcctgtggctgtctga

SEQ ID NO: 1466 - protein, 353 aa, Synechococcus sp. RS9916
MTTTSDLHVVETRPLLAPALLHADLPIDPGAADTVAGARRRIQSILSGEDRRMLVIVGPCSVHDVEAAREYARRLAPLRERHINELEVVMRVYFEKPRTTVGWKGLINDPHLDGSYDINTGLRLSRSLLLDLARDGMPTATELLDPVVPQYIADLISWTAIGARTTESQTHREMASGLSMPIGYKNSTDGSATIAINAMQAASKPHHFLGINHSGQASIVSTTGNPHGHLVLRGGNRGTNFHLEAVESAAAELANAGLVDRLMVDCSHGNSNKDYRRQGEVLQAVAEQVQQGSTHLMGVMLESHLVEGNQKLNADRAAMTYGQSVTDACISLDTTAGLLEQLASAVAAAPVAV

SEQ ID NO: 1467 - DNA, 1014 bp, Vibrio sp. Ex25
  CDS (1)..(1014): transl_table=11
atgcctaccccagcagagctaggtagtgtacatcctattacggatgacgttgcagaccgtatcgctcaatctcgtcgtcagattgaaaacattttatcgggtgaagacgatcgccttcttgcgattgtaggtccgtgttctgttcacgacactgaagctgccattgattacgccactcgcctgagtgaaatccaagacaagtacaaagacgaactgtttatcgtgatgcgtacttactttgaaaagcctcgtacagtagttggttggaaaggtttaattaccgaccctaacctagatggctcttacgcgcttgaagctggtctccataaagcacgtaaactactactggatatcaacaagcttggtcttgcgactgctactgagtttcttgatatgattactggtcaatacatagcggatttgatcacgtggggcgcgatcggtgctcgtacaacagaatcgcaaattcaccgtgaaatggcatcggcgctgtcttgcccagttggtttcaaaaatggcacaaatggcaacgtaaaaattgcaattgatgcaattcgcgcatcgaaagcctcgcattacttctactctccagataagaatggccgcatgacggtttaccgtacaagtggtaacccatatggtcatattattttacgcggcggagagaaaggccctaactttgatgaagcgtcagtaaaacaagcgtgtgatgctctagccgagtttggcttgccacaacgtttggttgtggatttcagccacgcaaactgtcagaagcagcacagaaaacaaatcgacgttgctcaagacatttgtaaccaaattaagtcaggcagtactcgtattgcgggtatcatggctgaaagctttattcttgaaggcaatcagccaatgactgacatcaacaacctaacgtatggtcaatctattacagacccatgcctaggctgggaagatactgctacaatgctagatatgctggcaaacgccgttaaatcccgaaagtccctataa

SEQ ID NO: 1468 - protein, 337 aa, Vibrio sp. Ex25
MPTPAELGSVHPITDDVADRIAQSRRQIENILSGEDDRLLAIVGPCSVHDTEAAIDYATRLSEIQDKYKDELFIVMRTYFEKPRTVVGWKGLITDPNLDGSYALEAGLHKARKLLLDINKLGLATATEFLDMITGQYIADLITWGAIGARTTESQIHREMASALSCPVGFKNGTNGNVKIAIDAIRASKASHYFYSPDKNGRMTVYRTSGNPYGHIILRGGEKGPNFDEASVKQACDALAEFGLPQRLVVDFSHANCQKQHRKQIDVAQDICNQIKSGSTRIAGIMAESFILEGNQPMTDINNLTYGQSITDPCLGWEDTATMLDMLANAVKSRKSL

SEQ ID NO: 1469 - DNA, 1077 bp, Vibrio sp. Ex25
  CDS (1)..(1077): transl_table=11
atgcagaaaagtgagttgagcaatattaatattagcgaagagcaggttcttattaccccagaggagctaaaaaccaagcttcctttgagtgaaaaagcgcgccgctttattcaagagtctcgccaaactatcgctaatattattcataaaaaggatcatcgcctgctggttgtatgtggtccatgttctatccacgacgtggaagcggcgaaggattacgcaaaacgtcttaaagcgctctctgaacaactaagtgaccaactgtatattgttatgcgtgtttactttgaaaaaccacgcaccacggtcggctggaaagggctgattaacgatccgcacctcgatggcagcttcgatattgaacatggtctgcatgttggacgcgaactgctagtggaattggcagagatggaaatcccgctcgcgactgaagctctggacccaattagcccacaatacttggcggatacttttagttgggctgcgatcggcgcacgtactacggagtcacaaactcaccgtgaaatggcaagtggcctgtctatgccaatcggttttaaaaatggcacggatggcagtttggcaaccgcaatcaatgcgatgcaagctgcgtcttctagccaccgttttatgggaattaaccgtgagggacaagtagcgctattgaccactcagggtaatgctaatgggcatgtgatcttacgtggcggcaagcaaactaactacgactcagtgtcagttactgagtgtgagcaagaaatggcgaaatctggccttgatgcatcattaatggtggattgtagtcacgccaactcacgtaaagattaccgtcgccagccattagtcgcagaagatgttattcaccaaatccgtgaaggtaataagtccattatcggccttatgattgaaagccatatcaatgaaggaaatcaatcttctgacttagctctcgaagaaatgaaatacggtgtatctatcactgacgcatgtatcaattgggattcaactgaggcactattacgtcatgcacatgaagagctagtgcctttcttagaaaatcgtccaaaggctaattaa

SEQ ID NO: 1470 - protein, 358 aa, Vibrio sp. Ex25
MQKSELSNINISEEQVLITPEELKTKLPLSEKARRFIQESRQTIANIIHKKDHRLLVVCGPCSIHDVEAAKDYAKRLKALSEQLSDQLYIVMRVYFEKPRTTVGWKGLINDPHLDGSFDIEHGLHVGRELLVELAEMEIPLATEALDPISPQYLADTFSWAAIGARTTESQTHREMASGLSMPIGFKNGTDGSLATAINAMQAASSSHRFMGINREGQVALLTTQGNANGHVILRGGKQTNYDSVSVTECEQEMAKSGLDASLMVDCSHANSRKDYRRQPLVAEDVIHQIREGNKSIIGLMIESHINEGNQSSDLALEEMKYGVSITDACINWDSTEALLRHAHEELVPFLENRPKAN

SEQ ID NO: 1471 - DNA, 1050 bp, marine gamma proteobacterium HTCC2143
  CDS (1)..(1050): transl_table=11
atgaccaatcaaaacagtaccgacgacgttcatattgccgaaatgcgacctctagtctctcctgctattctgatggaagagttgcccttgggcgaagagcctgcttcgatgatacaaaaaaaacgcgctgatatcggccgcatatttaagggccaagacgaccgcttattagtcgttgtaggcccctgctccattcatgacccagaagcggccattgaatatgctacgcgcctgcgggacattataggattatttgattccgagctgctgattgtcatgcgcgtctatttcgaaaagccccgcactaccgtgggctggaagggactcatcaatgatccgcacttggatggcagcttcaatatcaatcaaggactccgggtagcaagacatttgctgcttgatgtggccgcgatgggcattcctgccggctgcgaatttctagatacaatttcaccgcagttttttgctgatctagttgcctggggcgctattggcgcgcgtaccactgaaagtcaggttcatcgtgaattagcatctgggctttcaatgccagtggggtttaaaaatggaactgacggcagtatacaaattgcaatagacgccattggtgctgcctctcatcctcaccactttctttccgtcaccaagcaaggtatttccgccattgtcaccactagcggtaacaccgactgccatattatcttgcgcggctctaataagggtcccaactatgagaaagaagccgtcaccgcggcaactgacatgttggtaaaaagcgggttgccacctcatctgatggttgattgcagccatggaaacagcagcaaagacttcagcagacagcctattgtcgcagcggatatcgccgatcaaatcgccgccggcaatgctgccatcgccggcgtaatgattgaaagcaatttaattgaaggcaaccaaaaaaacccagatatctacggtgtcagcattaccgatgcttgtatttcctgggaaaccaccgtgactactttggaaacattggctgctgcggtaaaggcgagacgaggctaa

SEQ ID NO: 1472 - protein, 349 aa, marine gamma proteobacterium HTCC2143
MTNQNSTDDVHIAEMRPLVSPAILMEELPLGEEPASMIQKKRADIGRIFKGQDDRLLVVVGPCSIHDPEAAIEYATRLRDIIGLFDSELLIVMRVYFEKPRTTVGWKGLINDPHLDGSFNINQGLRVARHLLLDVAAMGIPAGCEFLDTISPQFFADLVAWGAIGARTTESQVHRELASGLSMPVGFKNGTDGSIQIAIDAIGAASHPHHFLSVTKQGISAIVTTSGNTDCHIILRGSNKGPNYEKEAVTAATDMLVKSGLPPHLMVDCSHGNSSKDFSRQPIVAADIADQIAAGNAAIAGVMIESNLIEGNQKNPDIYGVSITDACISWETTVTTLETLAAAVKARRG

SEQ ID NO: 1473 - DNA, 1098 bp, marine gamma proteobacterium HTCC2143
  CDS (1)..(1098): transl_table=11
atgagcagtgacagcaataacgccaacaacgaaaaactggttgataatcttaatgtggaatcacaggaaatactgattacacctgagcagctcaaaacagccctacccatgtcggccaaagccgctaatagcattgccgaaagccgtgaagtcattcgcaatatactcgacggcaatgacccgagactttttgtggtggttggcccctgctcgattcatgatgtcgacgccgcgatagattatgctcaccgcttgaaagcgcttgctgaggaagttgccgacacgttatacattgtcatgcgtgtctattttgaaaagccccgcacaacggttggctggaaaggtctaattaatgacccctatttaaacgacacttttaaaatacaagaaggtcttcacattggacgtaaattactgctggatatcgcagatataggccttccgacttcgacggaagcgctggacccgatttcaccacaatacatgcaagactgtattgcctggtcagcgattggcgcacgaaccaccgaatcacaaacacaccgtgaaatggccagcggcctgtcttctgccgtcggatttaagaatggcactgatggcggacttgatgttgcgatgaatgctattcaatcggctcaaaacccccaccgctttctcggcatcaatggtgagggacaggttgctattattcacacgaaaggcaacccttatgcccacgtagttttgcgcggcggatcaaatggacccaactttgattcggtccatattgaattgaccgaacaggcattaagcaaagcaggtgctgccaataatattatggttgattgctctcacgccaactccagcaaggaacctgagttgcaaccgaaagttatggaagatatcagcaatcaaatcgttgttggtaaccaatcaattgtcggtttgatgattgagtccaacatcaataaaggcaaccaatcgataccagctgatctgacgaagctcagctacggcgtttctgtaacagatggctgtattgattgggataccacggcaacagcgattcgaaacatgcgcgaccgactaaaagacgtgcttcccagccgaaaaaactaa

SEQ ID NO: 1474 - protein, 365 aa, marine gamma proteobacterium HTCC2143
MSSDSNNANNEKLVDNLNVESQEILITPEQLKTALPMSAKAANSIAESREVIRNILDGNDPRLFVVVGPCSIHDVDAAIDYAHRLKALAEEVADTLYIVMRVYFEKPRTTVGWKGLINDPYLNDTFKIQEGLHIGRKLLLDIADIGLPTSTEALDPISPQYMQDCIAWSAIGARTTESQTHREMASGLSSAVGFKNGTDGGLDVAMNAIQSAQNPHRFLGINGEGQVAIIHTKGNPYAHVVLRGGSNGPNFDSVHIELTEQALSKAGAANNIMVDCSHANSSKEPELQPKVMEDISNQIVVGNQSIVGLMIESNINKGNQSIPADLTKLSYGVSVTDGCIDWDTTATAIRNMRDRLKDVLPSRKN

SEQ ID NO: 1475 - DNA, 1077 bp, marine gamma proteobacterium HTCC2080
  CDS (1)..(1077): transl_table=11
atgtccaaaccccatgttcacaatgttaacgtcgccgcccagaaaattctggtagcacctgccgccttacgcgacatagttggcgtcgatgacgcactacaagatcgtgtcgctaagaccagagaggcgatcgaaaacatcctcgatagaaaagaccatcgtcttatggttgtcgtaggtccttgctccatccacgatgttgatgccgccatggaatatgctcataggcttaagcgtgtggccgaacaggtcggcgatacgctgcttttggtcatgcgcgtttattttgagaagccccgaacgacggttggttggaagggactgatcaatgaccctcatctcgatgattcctttgacattgaagcgggccttacgattgggcgctcacttttgaaagacattcaacagctgggcttacccacggctaccgaagcgctggacccgatcaccccacagtacttacaagacttaattagctggtcagcaataggcgctagaacaaccgaatctcaaacccatcgagaaatggccagcggcttgtcttcagcggttgggttcaaaaatggtaccgatggcggacttgaagttgccgtcaatgccatgaaatcagtatgtaacccccatcgttttctgggtattaacagcgaaggaaaagtctcggtatttgagactcgaggcaatccctatggccatgtcgttttaagaggtggttctgctggccccaactacaacagtcaacatattgggctgtgtgaagaggcactcgaacaagccgccttgcctgccaacatcatggttgattgcagtcatgccaataccgaaaaacaacccgaccgccagcccgcagtggctgcagacgtaactgagcagattatcgcaggcaatcgatcaatcattggtttaatgctcgagagtaaccttaaagccggcaaccagaaaattcccagcaacctcgatgatctggagtacggggtttcagtcaccgatggctgcattgattgggacaccacagaaaccttgcttgtggatattgcgaataaactgcggaacgttctgcctgggcgcgctacggcttaa

SEQ ID NO: 1476 - protein, 358 aa, marine gamma proteobacterium HTCC2080
MSKPHVHNVNVAAQKILVAPAALRDIVGVDDALQDRVAKTREAIENILDRKDHRLMVVVGPCSIHDVDAAMEYAHRLKRVAEQVGDTLLLVMRVYFEKPRTTVGWKGLINDPHLDDSFDIEAGLTIGRSLLKDIQQLGLPTATEALDPITPQYLQDLISWSAIGARTTESQTHREMASGLSSAVGFKNGTDGGLEVAVNAMKSVCNPHRFLGINSEGKVSVFETRGNPYGHVVLRGGSAGPNYNSQHIGLCEEALEQAALPANIMVDCSHANTEKQPDRQPAVAADVTEQIIAGNRSIIGLMLESNLKAGNQKIPSNLDDLEYGVSVTDGCIDWDTTETLLVDIANKLRNVLPGRATA

SEQ ID NO: 1477 - DNA, 1071 bp, marine gamma proteobacterium HTCC2080
  CDS (1)..(1071): transl_table=11
atgccttcaattaccgatgatactcgtatttcgtccctcaaagagctggctgcgcccagtgatttgctgaatcagatacccctcgatgagaccgttgctactcacgtgacgcaggccagaggagcaatacataacgtactgaaaggtgacgatgaccgtcttgtagtggtggtgggtccctgcagtattcatgacgtagatgcggcgattgattacggcaggcgcctccagcccctcgctgaaaaattgagtgatcgcctgctagttgttatgcgggtgtattttgaaaagcccagaacgacggtagggtggaaaggattaattaatgatcccgatctagacgattcctttcaaatcaacaagggtcttcgtttggctaggcaactgttggtagacctcaataaattggggttgcccacaggcaccgagtatcttgatcttatatctcctcaatatttcgctgatctagtgagttggggtgcaataggtgcaagaacaacggagagtcaaacccatagagagctcgcctcggggctgtcatgccctgttggctttaaaaatggtaccgatggagatgtgcaaatggcggtcgatgcaattggtgcagcgcgtcaaccccatcattttctttctgttactaaagaggggcagtcggcaattttcgaaacactgggtaacgaagattgtcatgtgattctgcgcggcggacataagccaaactacgacatgtttgcggtcgacgatgcccgggcgctgctgggcaaagcaggtttgtccgatcgtttaatgattgacgcgagccacgctaacagccgcaagcaaccggagcgtcagcttgaagttctggccaatatcggtcaacaggtagcgggtggaaacgaggccattattggcgtcatgatcgaaagctttctggaggctggtcgtcagaatgttgttgagggtggcacactgatctacggccaaagcattactgatccttgtatcgattgggctgctactgaagatattttgatccgtctcgccgatgacgtggcccaaagacgcctgaaacagggaggtagttcgtga

SEQ ID NO: 1478 - protein, 356 aa, marine gamma proteobacterium HTCC2080
MPSITDDTRISSLKELAAPSDLLNQIPLDETVATHVTQARGAIHNVLKGDDDRLVVVVGPCSIHDVDAAIDYGRRLQPLAEKLSDRLLVVMRVYFEKPRTTVGWKGLINDPDLDDSFQINKGLRLARQLLVDLNKLGLPTGTEYLDLISPQYFADLVSWGAIGARTTESQTHRELASGLSCPVGFKNGTDGDVQMAVDAIGAARQPHHFLSVTKEGQSAIFETLGNEDCHVILRGGHKPNYDMFAVDDARALLGKAGLSDRLMIDASHANSRKQPERQLEVLANIGQQVAGGNEAIIGVMIESFLEAGRQNVVEGGTLIYGQSITDPCIDWAATEDILIRLADDVAQRRLKQGGSS

SEQ ID NO: 1479 - DNA, 1089 bp, Amycolatopsis orientalis
  CDS (1)..(1089): transl_table=11
atgacaacatctactcccgccgccgcggtcgacctcgacaaccagaggatcgaccgcatagtcccattggtgacaccggccctgctgcaccatgaactgccgctcagcgccaaggcagccgacaccgtgcgacgaggtcgtgagaacgtccttcgcgtcctcgacggtacggatgaccggctgctcgtgatcactggaccgtgctccatccacgacccggccgcggccctcgactacgccgaccacctcgccacgatggccggccggttcactgacgacctcctgatcgtcatgcgcgtgtacttcgagaaaccgcgaacggtcggtggctggaaagggctcatcaacgacccccacctcgacggcaccggcgacgtgaaccacggcctgcgaatcgcccggcacctgttgctggagctcgccgaacgcggcctgcccgtcgcgtgcgagtggctggacacgaccatcccggcctacctcgccgacaccgtttcctggggcgcgatcggtgcccgcaccgtggaaagccaaaaccaccgcatgctcgccagcggtctgtccatgccggtcggcttcaagaaccgccgcgacggcgacatcaccgtggccatcgacgcgatccgcgctgcggcggcccgtcacgtcgttcctggcgtcgaccccggcggcttgcccgccatcctgcacaccgccggcaaccccgactgccatcttgttctgcgcggcggcaattccgcgcccaaccacgacgcctcgtctgtccacacagcactcaccgcgctgcaggacgccggtcttccccgccgggtcgtgatcgatgccagccatgacaacagccgcaaggaccaccaccggcaacctgttgtcgccgggcagatcgccgaccaggtcaagggcggccaacgcggcattgttggcgtgatgctcgaatccaacctccgcgccggccgccaggacctccgccccggccagcctctgacctacggccagtccatcacggacgcctgcatcgacatccccacgacgcagaccgttctgcagaccctcgccacggcaaccgcggctcggcggcgtctcagccagaactga

SEQ ID NO: 1480 - protein, 362 aa, Amycolatopsis orientalis
MTTSTPAAAVDLDNQRIDRIVPLVTPALLHHELPLSAKAADTVRRGRENVLRVLDGTDDRLLVITGPCSIHDPAAALDYADHLATMAGRFTDDLLIVMRVYFEKPRTVGGWKGLINDPHLDGTGDVNHGLRIARHLLLELAERGLPVACEWLDTTIPAYLADTVSWGAIGARTVESQNHRMLASGLSMPVGFKNRRDGDITVAIDAIRAAAARHVVPGVDPGGLPAILHTAGNPDCHLVLRGGNSAPNHDASSVHTALTALQDAGLPRRVVIDASHDNSRKDHHRQPVVAGQIADQVKGGQRGIVGVMLESNLRAGRQDLRPGQPLTYGQSITDACIDIPTTQTVLQTLATATAARRRLSQN

SEQ ID NO: 1481 - DNA, 1182 bp, Ustilago hordei
  CDS (1)..(1182)
atgtcgtcgagcattgcaaacaacaccgccaacggacgatccgccgagcctctctcgcaggctatcctcaaaagcggcactaaagacgaatacgcctacgtcaacgatgttcgcgttgctggctttgagcccttgatctctccctcgctcctccttcacgagattcccgtccctaaggaatcacaaaccaccatcgctcgcgcacgtggtcagtccagcgctatcatcaacggccaggacgaccgtcttcttgtcgtcgtcggtccttgctccatccacgatgtggaccaggctaaagaatacgctaagctgctcaaggctggtattgacgagcgctggtctgaaggccttgtcgtcatcatgcgcgcctacttcgaaaagccacgtactactgttggctggaagggtttgatcaacgaccccgacatcaatggcagcttccaaatcaaccgaggtctcaaaatcgcacgtaacctgctcgtcgacttgaccgcccaaggtgtccccgtggcatgcgaggttcttgacaccatctctccccagtacacttccgacctctactcttggggagccattggtgctcgtaccactgaatcgcaattgcaccgagaattagtctccggtctctccatgcccatcggtttcaagaacggcactgacggaggtcttggtgttgccgtcgacgccatccgtgcctcttcccaacctcacgctttcatgggtgtgaccgaacaaggtctcgctgccatcgtccgtactgtcggtaatgccgatctccacattgtccaccgcggcggctcaaatggaaccaacttcgattccgagtcggtcaaatcttccaaagctcgacttcaaaaagctctcccagaccgtcacccttccatcatgatcgattgttcccacggtaattcgaacaaagacttccgcaaccagcccaaggtcgttgatgctatcgcagagcagctcgagcagggagaggatgcgatcacgggtgtaatgatcgagagtcacttgaacgagggtaaacagggtgagcccaagaacggtcagattgatcagttgaagtacggtgttagcattacagatggttgcgtgggttgggagactacggtggagatgttggataagttgaatgcttctgttctgaagaggaggagtttgagggctcagaacaaggcctaa

SEQ ID NO: 1482 - protein, 393 aa, Ustilago hordei
MSSSIANNTANGRSAEPLSQAILKSGTKDEYAYVNDVRVAGFEPLISPSLLLHEIPVPKESQTTIARARGQSSAIINGQDDRLLVVVGPCSIHDVDQAKEYAKLLKAGIDERWSEGLVVIMRAYFEKPRTTVGWKGLINDPDINGSFQINRGLKIARNLLVDLTAQGVPVACEVLDTISPQYTSDLYSWGAIGARTTESQLHRELVSGLSMPIGFKNGTDGGLGVAVDAIRASSQPHAFMGVTEQGLAAIVRTVGNADLHIVHRGGSNGTNFDSESVKSSKARLQKALPDRHPSIMIDCSHGNSNKDFRNQPKVVDAIAEQLEQGEDAITGVMIESHLNEGKQGEPKNGQIDQLKYGVSITDGCVGWETTVEMLDKLNASVLKRRSLRAQNKA

SEQ ID NO: 1483 - DNA, 1137 bp, Aspergillus oryzae
  CDS (1)..(1137)
atgttactcgattctagtaatttcttcatcgaaaatcccaatgtaggggacaccaaccatctggaggactcgagaattcgaggatataaccctctgacaccccccaaccttctccaacatgagattgctatgacagaaacttccagacagacggtcttgcaagcccgtcaggaggctagcgcagtcgttcatggcaccgacaccgacaagcgccgtctgctggtcgtagtgggaccctgctcgattcacgatcccgaaatggcccttgaatactgtgaccgtcttttaaaactgaaggagaaatacaaggatgagcttttgattgtcatgcgtgcctacctggagaagccacgtaccactgttggctggaagggtctcataaacgaccccgatatcgacaacagcttcaagatcaacaagggtctgcgcacatctcgccaacttttcgtcgatctgaccaacaagggcatgcccattgctagcgagatgctggacactatctccccgcagttcctggctgactgtctctccgttggtgcggttggcgcgcggacaaccgagtcccaggtccaccgtgagctggcttctggtctttccttccccgttggattcaagaacggcaccgatggctctttggatgttgcagtggatgccattggctcggtcaagcacccccatcacttcctctccgtcaccaagcctggtgttgtctccatcgtcggcaccgtgggtaaccccgactgtttcgtcatcctccgtggtggaaagaagggccccaactacgatgctcagagcatcgccgaggccaaggccaaactttctgcacagggcatggagccccgtctcatggtggactgcagccacggtaactcgcaaaagaaccacaagaaccagcccaaggtggctgctgtgctcgcggaacagatcgctgcgggtgagaccgcaatcatgggtgtcatgatcgagagtaacatcaacgagggtaaccagaaggtcccgcctgagggcaaggccggcctcaagtacggtgtcagtatcaccgatgcttgcattcactgggaagacacggaagctgttcttgagaacctcgcccaggccgttcgtactcggaaagagaaattggcggtcaacaactag

SEQ ID NO: 1484 - protein, 378 aa, Aspergillus oryzae
MLLDSSNFFIENPNVGDTNHLEDSRIRGYNPLTPPNLLQHEIAMTETSRQTVLQARQEASAVVHGTDTDKRRLLVVVGPCSIHDPEMALEYCDRLLKLKEKYKDELLIVMRAYLEKPRTTVGWKGLINDPDIDNSFKINKGLRTSRQLFVDLTNKGMPIASEMLDTISPQFLADCLSVGAVGARTTESQVHRELASGLSFPVGFKNGTDGSLDVAVDAIGSVKHPHHFLSVTKPGVVSIVGTVGNPDCFVILRGGKKGPNYDAQSIAEAKAKLSAQGMEPRLMVDCSHGNSQKNHKNQPKVAAVLAEQIAAGETAIMGVMIESNINEGNQKVPPEGKAGLKYGVSITDACIHWEDTEAVLENLAQAVRTRKEKLAVNN

SEQ ID NO: 1485 - DNA, 1095 bp, Aspergillus oryzae
  CDS (1)..(1095)
atgcccctcgttaacacaacagaggtcaatgaggacactcgtgtccttggatacgatccattgctgtcccctcagtaccttcagtccgagatcccagctcctgcagaagccactgccactgtccgctcgggccgtaaccaagccgttgagattattgagcagcgcgatgaccgtctgctggtgatggtcggcccctgctccatccatgaccctgccaccgctctggaatatgccacccgtctcaaggagctcgctgggaagctctcctccgacctttgcatcatcatgcgcgcttatttggagaagccccgcaccacagtgggatggaagggtctgattaacgacccggatattgacgaatcctacaacatcaacaagggtctgcgcatctcacgtaagctctacgccgatctgaccagcatgggcatgccaattgccagtgagatgctcgataccatctctccccagtaccttgcggatctcatctcactcggcgccatcggtgcccgtacgaccgagtcccaattgcaccgtgagctggcctccggtctgagtttccccattggctacaagaacggcacggacggcaacctcgtcgtcgccattgatgctattggtgctgccgctcacccccaccgtttcctcggtgtcactaagcagggtctcgcggccatcaccaagacctccggtaacgagcacggtttcgtgatcttgcgtggaggcagcaagggtaccaactatgaccgggagagcatccgtcaggctcgcgaagccctgcgtagcaagaagcagcgtgaggtgctcatggtcgactgctcccacggcaactccaacaagaaccaccgcaaccagcccctggtcgccaaggaagtcgccgaccagatgcgcgagggccaggatgctattgttggtgtcatgatcgagtccaacattcatgagggcaaccagaaggtccctgccgagggcccgaagggccttaagaagggtgtcagcatcacggatgcctgcattgactgggagaccaccgtcaccgtgttggaggatctcgccgatgccgtccgcgctagacgtgccgccaaggcatccagcgcctga

SEQ ID NO: 1486 - protein, 364 aa, Aspergillus oryzae
MPLVNTTEVNEDTRVLGYDPLLSPQYLQSEIPAPAEATATVRSGRNQAVEIIEQRDDRLLVMVGPCSIHDPATALEYATRLKELAGKLSSDLCIIMRAYLEKPRTTVGWKGLINDPDIDESYNINKGLRISRKLYADLTSMGMPIASEMLDTISPQYLADLISLGAIGARTTESQLHRELASGLSFPIGYKNGTDGNLVVAIDAIGAAAHPHRFLGVTKQGLAAITKTSGNEHGFVILRGGSKGTNYDRESIRQAREALRSKKQREVLMVDCSHGNSNKNHRNQPLVAKEVADQMREGQDAIVGVMIESNIHEGNQKVPAEGPKGLKKGVSITDACIDWETTVTVLEDLADAVRARRAAKASSA

SEQ ID NO: 1487 - DNA, 1173 bp, Paxillus involutus
  CDS (1)..(1173)
atgcagtcgtacaacgttactccagttcctgaggatgacaagcaacttctagagtacatgcaagacagacgtgtcctcgggtacgaccccctagtccagcctgctttgctcagacacgaagttactcctaccgaatactcgcgtctcattattgcctctgcccgctataactccgctcgcgtagttgccggacaagatgacagagttctcgtgatcgtcggtccttgctcaatccactccccagagcaagccatcgagtatgccaaactgctccaagctaaaattcccacttgggaaaacctagtcatcgttatgcgggcttacttcgaaaaaccaaggacaaccgtcggctggaaaggcttgattaatgaccctgacatcgatggatccttccacatcaacaagggtcttcgggtcgccagacagctcctttgtgacttaaccaaccttggtatcccagtcggctccgagttactcgataccatctccccacagtacatcgcagatcttatctcttggggtgccatcggtgcccgaacaacggaatcccaactccaccgagagcttgcttctggtgtctccttccccattgggttcaagaacggcactgatggaagtgtgtcggtcgccattgatgccatgcgctcgtcttccaatcctcatgctttcatgggtgtgaccgagcggggtctagccgctattgtcaagactcggggtaaccaggatgttcatgtcatcctccgtggagggaccaagggcccgaactacgcgtctgagcacgtcaagtcggccgcaaaagctatcgagaaggctcgaccacagagccacccaagtctcatgattgactgtagccacggtaactcgcaaaagaatcataacaatcagcccaaggttgtcgatgacatttgcacacagctcgctgctggtgaccgaaccatcacgggtgtcatgatcgagtcgcacatcaacgctggtcgtcaggacgttcctgcagaaggccctggtggactcaagtacggcgtcagtatcaccgacgcttgcgttgactgggaggttaccgttggtatgctcgacaggcttaatgaggcagttggccaacgccgcgcctacctcgttgaacagggtttccagagacctgctgggttccaacgagagacacctttgacgccttga

SEQ ID NO: 1488 - protein, 390 aa, Paxillus involutus
MQSYNVTPVPEDDKQLLEYMQDRRVLGYDPLVQPALLRHEVTPTEYSRLIIASARYNSARVVAGQDDRVLVIVGPCSIHSPEQAIEYAKLLQAKIPTWENLVIVMRAYFEKPRTTVGWKGLINDPDIDGSFHINKGLRVARQLLCDLTNLGIPVGSELLDTISPQYIADLISWGAIGARTTESQLHRELASGVSFPIGFKNGTDGSVSVAIDAMRSSSNPHAFMGVTERGLAAIVKTRGNQDVHVILRGGTKGPNYASEHVKSAAKAIEKARPQSHPSLMIDCSHGNSQKNHNNQPKVVDDICTQLAAGDRTITGVMIESHINAGRQDVPAEGPGGLKYGVSITDACVDWEVTVGMLDRLNEAVGQRRAYLVEQGFQRPAGFQRETPLTP

SEQ ID NO: 1489 - DNA, 1572 bp, Xanthomonas oryzae pv
  CDS (1)..(1572): transl_table=11
gtgtcgaaacacgcgcggccgtttgaagtggcgatgcgccgggcggactgtgagatttaccgaggcggccggtgcgatcattgcttgattgtttgttcgcatcgagccgattggctgcagcgatgtcgccgctcgacaggggggcatcggccctgcaacctgtgcccaaatcactgctgcaacggtaattgcgctcctctgtacgtgtctgccagcagctgcaaaggacggttgcccaaccccgtccccggttccgttgccgatgaaacagtagcaacgcgcaaatgtgcgtggtatcaatgcacgcatgaacgcaccccgcagccagttttatttttggtactacggttttccaatgccgctggcggaggaaggattgcgctcaccctgaaggacacttcagcagcattcccaaaaagccgccagcgcacactggcggcttttttgttgccgccttgcctggctccccgatgcaacaccgcccaccgagacactgttatgccgcctgtgaccgatgacctgcgtatccgcaagatcgaagccctcgcaccgccttcgcagctgctgtcgctgctgccctgcgatgagcgcgcctccgaaaccgtgaccaacgcgcgcgctgcgctgcacaagatcctgcacgggcgcgacgaccgcctggcggtggtgatcgggccctgctcgatccacgacccggtggcggcgatggagtacgcgcagcgcctgcgcccattgcgtgaccaattcggcgacgcgctggagatcgtgatgcgggtgtacttcgaaaagccgcgcaccaccatcggctggaagggcctgatcaacgacccggatctggatggcagcttccagatcaacaaaggcctacgcgtagcgcgcggcttgctgcgcgacatcaacaatctcggcttgccggccggcgtggaatttctcgacatcatttcgccgcaatacatcgccgatctggtggcctggggcgcgatcggtgcccgcaccaccgagagccaggtgcatcgcgaaatggcgtccggcctgtcgtgcccggtgggcttcaagaacggcaccagcggcgacgtcaagattgcggtggacgcggtaggcgcggcctcgcatccgcatcatttcctggccgtgaccaaggacggacataccgccgtggcagccacggcaggcaatccggattgccacgtgattctgcgcggcggcaagcagcccaacttcgatgcagccaatgtggaagcggccagccaggtgctcaacaagtcgggcttgccggcgcgcctgatgatcgatgccagccacgccaacagcagcaagaaccccgagaaccagcccaaggtcatcgacgacatcagcaatcagctggaagcaggcgaaacgcgcatcgttggcgtgatggtggaaagtcaccttgtcggagggcgccaggaattgctgccgggttgcgcgctgacctacgggcagagcatcaccgatggctgcatcggttgggatacgtcggtgcaggtgctggaacgtctggcgacagcagtgcgcgcgcggcgtgcgcgacggattgccgaggctgcgtga

SEQ ID NO: 1490 - protein, 523 aa, Xanthomonas oryzae pv
MSKHARPFEVAMRRADCEIYRGGRCDHCLIVCSHRADWLQRCRRSTGGHRPCNLCPNHCCNGNCAPLYVSASSCKGRLPNPVPGSVADETVATRKCAWYQCTHERTPQPVLFLVLRFSNAAGGGRIALTLKDTSAAFPKSRQRTLAAFLLPPCLAPRCNTAHRDTVMPPVTDDLRIRKIEALAPPSQLLSLLPCDERASETVTNARAALHKILHGRDDRLAVVIGPCSIHDPVAAMEYAQRLRPLRDQFGDALEIVMRVYFEKPRTTIGWKGLINDPDLDGSFQINKGLRVARGLLRDINNLGLPAGVEFLDIISPQYIADLVAWGAIGARTTESQVHREMASGLSCPVGFKNGTSGDVKIAVDAVGAASHPHHFLAVTKDGHTAVAATAGNPDCHVILRGGKQPNFDAANVEAASQVLNKSGLPARLMIDASHANSSKNPENQPKVIDDISNQLEAGETRIVGVMVESHLVGGRQELLPGCALTYGQSITDGCIGWDTSVQVLERLATAVRARRARRIAEAA

SEQ ID NO: 1491 - DNA, 1035 bp, Escherichia coli
  CDS (1)..(1035): transl_table=11
atgcagtcagtcagtaaatcaatctaccgagggaagttgcttagcagtttacctgctgtgggcgagattcataaagaaatcgcagtatcagaagaaaccgtaacatggatctctctgcaacgagagattatagcgaatattttgctgggaaaagatcctcgcttgcttgtgattgttggtccatgctcaatccatgacgttcaggctgccgttgaatatgcgaaacgattgtccgtattacagaataagtacttatcgcaaatgtacattgtaatgcgcacttattttgagaaacctcgaactcgtaaaggctggaaaggaataatgcacgatcctgatctaaatggaagctataatgttgagaaagggatacgatatgctcgccagtgtttgtcctcaatcacaacaatgcgtgtcgcaaccgctacagaattcctcgatcctttccttactccctatattgctgatttaatatgttggggggctgttggtgccagaactactgaatcacaaacgcatcgtcaacttgcgtctggtttacattgtcctgttggatttaaaaacagcactgatggaaatattaacttagctattgatgctattcttgcagcccgtgaacaacatgttgtatatatgacatctttaacaaaatgtatatctaccctattaaccgatggcaatccacatggacatctcatattacgtggtggtagagagccgaactatggtttgtcggatataacgaaggcagtgaaattaatgcatgatgaaggtatcaatcatcgtctgataattgactgtagccatggtaatagtggtaaagtggctgaacggcaaatctctgttgctcgtgaagtcattgataatcggaaaaagatgccgggatatgtagctggaattatgctggaaagctttttacaaggtggaaaacaatcagacagccttccgcgagagtatggtcagtctgttactgatgagtgtctttcatggcaacagacagaacaattattatcaactctggcagcacaactttaa

SEQ ID NO: 1492 - protein, 344 aa, Escherichia coli
MQSVSKSIYRGKLLSSLPAVGEIHKEIAVSEETVTWISLQREIIANILLGKDPRLLVIVGPCSIHDVQAAVEYAKRLSVLQNKYLSQMYIVMRTYFEKPRTRKGWKGIMHDPDLNGSYNVEKGIRYARQCLSSITTMRVATATEFLDPFLTPYIADLICWGAVGARTTESQTHRQLASGLHCPVGFKNSTDGNINLAIDAILAAREQHVVYMTSLTKCISTLLTDGNPHGHLILRGGREPNYGLSDITKAVKLMHDEGINHRLIIDCSHGNSGKVAERQISVAREVIDNRKKMPGYVAGIMLESFLQGGKQSDSLPREYGQSVTDECLSWQQTEQLLSTLAAQL

SEQ ID NO: 1493 - DNA, 1086 bp, Amycolatopsis methanolica
  CDS (1)..(1086): transl_table=11
atgtctctcagcgcaggccccgcggaaatttccgaaggcctcgacaaccagcgcaccctcggcgtcagcccgctgatctcccccgccctgctgcggcaggagctgccggtggacgcggcgatcgccaagaccgtcgcgcatggccggtcgtcggccgtcgacatcctccacggcgacgacgaccgcctcatcgtggtcgtcggcccctgctcggtgcacgaccccgcggccgccctcgactacgcccaccggctggccgagcacgccgccggtgtgcgcgacgaactgcacgtgatcatgcgggtgtacttcgagaagccacgcaccacgctgggctggaagggcctcatcaacgacccggacctggacggcagctacgccgtcaacaagggcctgcggatggcgcgcaagctgctgctggacatctccgcactggggctgccggtcgggtgcgagttcctggacccgatcacgccgcagttcatcgccgacaccgtgagctggggatccatcggcgcgcggaccgcggccagccaggtgcaccgccagctgtgcagcgcgctgtccatgccggtggggatcaagaactccactgagggcgatgtgcaggtggcggtggacgcgacccgcgcggcggcggcgagccacgtgttcgcgggcatcaacaacgacggcctggcggcgctgttcaccacggcgggcaacccggactgccacgtcatcctgcgcggcggttccgcaggcccgaactacgacgcggcgacggtggccgacacgctcgcgcggcaggccaaggccgggctgccggagcgggtgatcatcgacgcgagccacggcaacagcggcaaggaccacgtccgccagggcgtggtggccggggagatcgcggaccggatcgccgccggcgagcgcgggatcgccgggatcatgctggagagcttcctcgaggccgggcggcaggacctggtgctggggcacgcgggcgagctgacctacgggcagtcgatcaccgatgcgtgcctggactggcgaagcacgggtgagctgctggaccgcctctcggaggcggtggcggcgcggcggtga

SEQ ID NO: 1494 - protein, 361 aa, Amycolatopsis methanolica
MSLSAGPAEISEGLDNQRTLGVSPLISPALLRQELPVDAAIAKTVAHGRSSAVDILHGDDDRLIVVVGPCSVHDPAAALDYAHRLAEHAAGVRDELHVIMRVYFEKPRTTLGWKGLINDPDLDGSYAVNKGLRMARKLLLDISALGLPVGCEFLDPITPQFIADTVSWGSIGARTAASQVHRQLCSALSMPVGIKNSTEGDVQVAVDATRAAAASHVFAGINNDGLAALFTTAGNPDCHVILRGGSAGPNYDAATVADTLARQAKAGLPERVIIDASHGNSGKDHVRQGVVAGEIADRIAAGERGIAGIMLESFLEAGRQDLVLGHAGELTYGQSITDACLDWRSTGELLDRLSEAVAARR

SEQ ID NO: 1495 - DNA, 1098 bp, Amycolatopsis balhimycina
  CDS (1)..(1098): transl_table=11
gtggccgcgatgacccacaccgtcgccacgaccgacctcgacaaccagcgcatcgagcggatcgtccccctggtcacccccgccctgctgcatcacgaactgccgctcagcgccaccgcggccgagacggtgcgaaagggccgcgagagcgtcgtccgcgtcctcgacggcacggacgaccggctgctcgtgatcaccgggccgtgctccatccacgaccccgccgcggcgctcgactacgccggccacctcgccgccatcgccggcgaggtcgccggcgacctgctcgtcgtcatgcgcgtgtacttcgagaaaccccggacgatcggcggctggaaggggctcatcaacgacccccacctcgacggcaccggcgacgtcaaccacgggctgcgcacggcccggcacctcctgctggagctcgccgaacgcggcctgcccgccgcgtgcgaatggctggacaccaccattcccgcgtacttcgcggacacggtctcgtggggcgccatcggcgcccgcaccgtggaaagccagaaccaccgcatgctcgccagcggcctgtccatgcccgtcggcttcaagaaccgccgcgacggcgacatcaccgtcgccatcgacgcgatccgggccgccgcggtccgccacgtggtccccggcgtcgaccccggcgggttgcccgccatcctgcacacggcgggcaacccggactgccacgtcgtcctgcgcggtggtgacggcgcgcccaaccacgactccgcgtccgtccacaagacactgaccgcgctggaggccgcgggcctgcccggccgggtggtgatcgacgccagccacgacaacagcggcaaggaccaccaccgccagcccctcgtcgcggccgagatcgcgggccaggtcgagaacgggcggaacggcatcgtcggggtgatgctcgagtccaacctccgcgccggccgccaggacctccagccgggccgtccgccggcatacggccagtccatcaccgacgcctgcatcgacgtccccaccacccggacggtcctccacggcctcgccgcggcggccgcggcccggcgaaagctcggcaagcaagcaagctga

SEQ ID NO: 1496 - protein, 365 aa, Amycolatopsis balhimycina
MAAMTHTVATTDLDNQRIERIVPLVTPALLHHELPLSATAAETVRKGRESVVRVLDGTDDRLLVITGPCSIHDPAAALDYAGHLAAIAGEVAGDLLVVMRVYFEKPRTIGGWKGLINDPHLDGTGDVNHGLRTARHLLLELAERGLPAACEWLDTTIPAYFADTVSWGAIGARTVESQNHRMLASGLSMPVGFKNRRDGDITVAIDAIRAAAVRHVVPGVDPGGLPAILHTAGNPDCHVVLRGGDGAPNHDSASVHKTLTALEAAGLPGRVVIDASHDNSGKDHHRQPLVAAEIAGQVENGRNGIVGVMLESNLRAGRQDLQPGRPPAYGQSITDACIDVPTTRTVLHGLAAAAAARRKLGKQAS

SEQ ID NO: 1497 - DNA, 1134 bp, Phytophthora infestans
  CDS (1)..(1134)
atgccgagcacccagccgcaccctgcacctgaaaccgaacgtgtgaccaagcgtcagcgtctagaagaccgtaatgtcgtcgccattaagccgctggtgcctcctgcctgcgtcctggaggaactgcccgtgactcctgaggtgcacgaactggtggacgctacgcgcgacgccgtgtcccgcatcctgcacggtcaagatgaccgcctcgtcgtggtcgtcggcccttgctccattcacgacgtggacgctgccatggactacgccaagcgtctgaaaactcttgcgggcgagctgaacggagaacttctggtgatcatgcgcacctacttcgagaagccccgaacgactgtgggctggaagggtctgatcaatgacccggacctcgaccagtctttcaagatcaacaagggtattcgcattgcccgtaagctgttgctggacgtgaattcgctgggtcttcccgtgagtctggagttcctcgacaccatctcgccccagttcacctcagacctcatttcgtggggagccatgggcgcgcgtactaccgagtcccagctgcaccgcgaacttaccagtggcctgtcgattcctgtgggattcaagaatggcacgggcggcaacgccaaggtggcagtggacgctgccgttgcttcgtcgcagcctcacaacttcctcggtctgaacgaacacggattggcatcgattgtgcgcaccaagggcaacaaggactgccacgtcatcctgcgcggcggctccgatggccccaactacgagcaaaagtacattgatgaggctgctgccatgctaaagaaggctaagcagccgtccaaaatcatggtggactgctcgcacggcaactcgcgcaagctgcacgctaaccagcgaaaggtagttagctacctggctggtattgtttccgagggaaacacgaatgtgcttggtgttatgatcgagtccaatatcgtggagggcaaccagtcgcttggcgacgacccgtccaagctcgtctacggccagagcatcacggatgcgtgcatcaactgggatgacacagtcacgacgctgaaggaacttgcaggtgccgtcgcaaagcggcgcaaacttgatgccgcgaacccggccaccaagtag

SEQ ID NO: 1498 - protein, 377 aa, Phytophthora infestans
MPSTQPHPAPETERVTKRQRLEDRNVVAIKPLVPPACVLEELPVTPEVHELVDATRDAVSRILHGQDDRLVVVVGPCSIHDVDAAMDYAKRLKTLAGELNGELLVIMRTYFEKPRTTVGWKGLINDPDLDQSFKINKGIRIARKLLLDVNSLGLPVSLEFLDTISPQFTSDLISWGAMGARTTESQLHRELTSGLSIPVGFKNGTGGNAKVAVDAAVASSQPHNFLGLNEHGLASIVRTKGNKDCHVILRGGSDGPNYEQKYIDEAAAMLKKAKQPSKIMVDCSHGNSRKLHANQRKVVSYLAGIVSEGNTNVLGVMIESNIVEGNQSLGDDPSKLVYGQSITDACINWDDTVTTLKELAGAVAKRRKLDAANPATK

SEQ ID NO: 1499 - DNA, 1035 bp, Escherichia coli
  CDS (1)..(1035): transl_table=11
atgcagtcagtcagtaaatcaatctaccgagggaagttgcttggcagtttacctgctgtgggcgagattcataaagaaatcgcagtatcagaagaaaccgtaacatggatctctctgcaacgagagattatagcgaatattttgctgggaaaagatcctcgcttgcttgtgattgttggtccatgctcaatccatgacgttcaggctgccgttgaatatgcgaaacgattgtccgtattacagaataagtacttatcgcaaatgtacattgtaatgcgcacttattttgagaaacctcgaactcgtaaaggctggaaaggaataatgcacgagcctgatctaaatggaagctataatgttgagaaagggatacgatatgctcgccagtgtttgtcctcaatcacaacaatgcgtgtcgcaaccgctacagaattcctcgatcctttccttactccctatattgctgatttaatatgttggggggctgttggtgccagaactactgaatcacaaacgcatcgtcaacttgcatctggtttacattgtcctgttggatttaaaaacagcactgatggaaatattaacttagctattgatgctattcttgcagcccgtgaacaacatgttgtatatatgacatctttaacaaaatgtatatctaccctattaaccgatggcaatccacatggacatctcatattacgtggtggtagagagccgaactatggtttgtcggatataacgaaggcagtgaaattaatgcatgatgaaggtatcaatcatcgtctgataattgactgtagccatggtaatagtggtaaagtggctgaacggcaaatctctgttgctcgtgaagtcattgataatcggaaaaagatgccgggatatgtagctggaattatgctggaaagctttttacaaggtggaaaacaatcagacagccttccgcgagagtatggtcagtctgttactgatgagtgtctttcatggcaacagacagaacaattattatcaactctggcagcacaactttaa

SEQ ID NO: 1500 - protein, 344 aa, Escherichia coli
MQSVSKSIYRGKLLGSLPAVGEIHKEIAVSEETVTWISLQREIIANILLGKDPRLLVIVGPCSIHDVQAAVEYAKRLSVLQNKYLSQMYIVMRTYFEKPRTRKGWKGIMHEPDLNGSYNVEKGIRYARQCLSSITTMRVATATEFLDPFLTPYIADLICWGAVGARTTESQTHRQLASGLHCPVGFKNSTDGNINLAIDAILAAREQHVVYMTSLTKCISTLLTDGNPHGHLILRGGREPNYGLSDITKAVKLMHDEGINHRLIIDCSHGNSGKVAERQISVAREVIDNRKKMPGYVAGIMLESFLQGGKQSDSLPREYGQSVTDECLSWQQTEQLLSTLAAQL

SEQ ID NO: 1501 - DNA, 1086 bp, Stigmatella aurantiaca
  CDS (1)..(1086): transl_table=11
atgaccgctcgcactgaaaatctgaacgtagttggtttcgaccacatgccctccccctccgagatcaaggagcgcgtgccgatgacaagcctcgcagccgacaccgtgctctccggacggcgcgcgctgatggacatcctcaaccgcaaggatccacgcatcttcgtcatcgtgggcccctgctccatacatgatcccaaggccggcatcgagtacgcccgtcgacttcgcaacctctccgacgagatccgggagacgatcctcgtggtgatgcgggtgtacttcgagaaaccgcgcacctccaccggctggaagggcttcatcaacgacccgaggatggacgactccttccacatcgaggaaggcatggagcggggccgccgcttcttgagggacgtggccgaactgggcctgcccgcggcgaccgaagcgctcgatcccattgccccccagtattacggcgacctgatttcctggacggcgattggcgcgcgcacggcggagtcccagacccaccgcgagatggcctcggggctgtcgacgcccgtgggcttcaagaacggaaccgacggctcgctggacgcggcggtcaacggcatcctctccgcctcgcacccccacagcttcctggggctgaacgagggcggtgaggcggcgatcatccgcaccggaggcaatgcctacagccacctggtgctccgaggcggagggggacggcccaactacgacacggtgtccatcgcgctcgccgaacaggcgctcaccaaggccaagctgccggggaacatcgtggtggactgctcccacgccaactcctggaagaagccggagttgcagcccctggtcatgcgcgacgtggtgcaccagatccgcgaaggcaaccgctccgtggtgggtttgatgctcgaaagcttcctggaagcgggcaaccagcccatccccgccgatctctcgaagctgcgctacggctgctcggtgaccgatgcgtgcgtggactggggcaccaccgaagagacgctgcgcaacgcccacaaggtgctgcgcgaggcattgcccacgcggagctcgggccgcccagcgccctga

SEQ ID NO: 1502 - protein, 361 aa, Stigmatella aurantiaca
MTARTENLNVVGFDHMPSPSEIKERVPMTSLAADTVLSGRRALMDILNRKDPRIFVIVGPCSIHDPKAGIEYARRLRNLSDEIRETILVVMRVYFEKPRTSTGWKGFINDPRMDDSFHIEEGMERGRRFLRDVAELGLPAATEALDPIAPQYYGDLISWTAIGARTAESQTHREMASGLSTPVGFKNGTDGSLDAAVNGILSASHPHSFLGLNEGGEAAIIRTGGNAYSHLVLRGGGGRPNYDTVSIALAEQALTKAKLPGNIVVDCSHANSWKKPELQPLVMRDVVHQIREGNRSVVGLMLESFLEAGNQPIPADLSKLRYGCSVTDACVDWGTTEETLRNAHKVLREALPTRSSGRPAP

SEQ ID NO: 1503 - DNA, 1083 bp, Amycolatopsis mediterranei
  CDS (1)..(1083): transl_table=11
atgacgctctccgccggaccggccaccatcggtgacctcgacgccgcccgcaccacgtcgatcagtccgctcatttcgcccgcactgctgcgcgaagaccatccggtcgacgccgcggtcgcgaaggtggtgcgccacggccgcgccgagacggtcgacatcctcgaaggccgcgacgaccggctgctcgtcgtggtcggcccgtgctcggtgcatgaccccgaagccgccctcgactacgcccgccggctggcggcgaaggccgaggagctgcgcggcgagctgcacgtcgtgatgcgcgtgtacttcgagaagccgcgcaccacgctgggctggaagggcctgatcaacgacccggacctcgacggcacgttctccgtcaacaagggcctgcggatggcgcgcaagctgctgctcgacgtgtccgagctggggttgccggtcggctgcgagttcctcgacccgatcacgccgcagttcatcgcggacatcgtgacgtggggttcgatcggtgcccgcacggcggccagccaggtccaccgccagctgtgcagcgcgctgtcgatgccggtgggcatcaagaactccaccgagggcgacgtccaggtggcgatcgacgccacccgcgcggcggcggccagccacgtgttcccgggcatcaacaccgacggcctggcggcgctgctgacgacgtccggcaacccggactgccacgtgatcctgcgcggccacaacaccggcccgaactacgactcgctcactgtcgccgacaccctggcccggctggcgaaggcgggcctgccggagcgggtgatcatcgacgcttcgcacgggaacagcggcaaggaccacgtgcggcagggcgcggtggtgtccgagctggctgcgcggatcgcggcgggcgagcgcgggatttccgggctgatgatggagagcttcctggccggtgggcggcaggagctttcgctggggcacgcctcggagctgacctacgggcagtcgatcacggacgcgtgcctggcctgggacgacaccgcgccgctgctggacgagctcgcctcggcggtgcgggcgcgccgctga

SEQ ID NO: 1504 - protein, 360 aa, Amycolatopsis mediterranei
MTLSAGPATIGDLDAARTTSISPLISPALLREDHPVDAAVAKVVRHGRAETVDILEGRDDRLLVVVGPCSVHDPEAALDYARRLAAKAEELRGELHVVMRVYFEKPRTTLGWKGLINDPDLDGTFSVNKGLRMARKLLLDVSELGLPVGCEFLDPITPQFIADIVTWGSIGARTAASQVHRQLCSALSMPVGIKNSTEGDVQVAIDATRAAAASHVFPGINTDGLAALLTTSGNPDCHVILRGHNTGPNYDSLTVADTLARLAKAGLPERVIIDASHGNSGKDHVRQGAVVSELAARIAAGERGISGLMMESFLAGGRQELSLGHASELTYGQSITDACLAWDDTAPLLDELASAVRARR

SEQ ID NO: 1505 - DNA, 1125 bp, Emericella nidulans
  CDS (1)..(1125)
atgtcctccttcttccttccaaatcctaatttaggagatagcaatcaccttgaggattcaagaatccgcggatacaaccctctcacaccacccaacctcctgcaacatgagattgctctaacagagaaagcgcggcaaacggtccttcaaggccgagccgaggccattgccgtcgcccacggcacagacacagacaagcgccgcctcctcgtcgtcattggaccctgctcaattcacgaccccgaaatggccttagagtactgcgaccggctattgaaattgaaggagaaatacaaggatgagttgctaattgttatgcgctcttatctggagaagccccgaacgaccgtcggttggaagggcctcatcaacgacccggatatcgacaacagcttcaacatcaacaagggcctgcgcatctcgcgtcagctcttcgtcgacttgaccaacaagggaatgccaattgccagtgagatgctggacactatctccccgcagtttctggcggactgtctctccgtcggtgcggtcggcgcacggacaaccgaatcgcaggtccatcgtgaattggcctctgggctctcgttccccgttggcttcaagaacggtacagatggctcgttagacgtcgcggttgatgcgattggatccgtaaaacaccctcatcacttcctgtccgtcaccaagcctggtgttgtcgccattgtcggtaccgttggcaatcctgattgctttgttatcctccgcggcggcaagaaagggccgaactacgatgctgctagcatcaccgaagcaaaggagaagctcatagctaagggtctggcaccccgtctgatggtcgactgcagccacggcaactcacaaaaggatcacaagaaccagcctaaggtggcagctgttcttgcggagcagattgctgcaggcgaaaccgcaatcatgggcgtcatgatagagagtaatatcaacgagggcaaccaaaaggtcccacccgagggcaaggccggcctcaaatacggcgtcagtatcaccgacgcctgtatcaattgggaagacaccgagtcaacgctagagacccttgcaaaggctgttgcgactcggagagaaaagctcgcccccagttcatag

SEQ ID NO: 1506 - protein, 374 aa, Emericella nidulans
MSSFFLPNPNLGDSNHLEDSRIRGYNPLTPPNLLQHEIALTEKARQTVLQGRAEAIAVAHGTDTDKRRLLVVIGPCSIHDPEMALEYCDRLLKLKEKYKDELLIVMRSYLEKPRTTVGWKGLINDPDIDNSFNINKGLRISRQLFVDLTNKGMPIASEMLDTISPQFLADCLSVGAVGARTTESQVHRELASGLSFPVGFKNGTDGSLDVAVDAIGSVKHPHHFLSVTKPGVVAIVGTVGNPDCFVILRGGKKGPNYDAASITEAKEKLIAKGLAPRLMVDCSHGNSQKDHKNQPKVAAVLAEQIAAGETAIMGVMIESNINEGNQKVPPEGKAGLKYGVSITDACINWEDTESTLETLAKAVATRREKLAPSS

SEQ ID NO: 1507 - DNA, 1062 bp, Vibrio cholerae
  CDS (1)..(1062): transl_table=11
atgccactgaaaaccgatgaattaagaacccaagcattgggacctatgcctactccggcagaattaagtcacgcacatcctatcactgatgaagttgcgctacggatcgcgcagtctcgtcgccaaattgaaagcattcttaccggtgaagatgatcgcctattagtgatagtggggccttgttcggtgcatgataccgatgccgcactcgactacgctcgccgccttgctgcgctacaagaaaactatactgatgagctttttgtggtgatgcggacctatttcgaaaaaccacgtactgtggtgggttggaaaggactgatcaccgatccaaacttagatggctcttacgctttagaaaccggtctcaataaagcgcgaaagttgctgcttgatgtaaacaagctcggattggctaccgcgaccgagtttcttgatatgatcacaggccaatacatcgcggaccttatcacgtggggcgcaattggtgcgcgtaccactgagtcgcaaattcaccgtgagatggcctctgcgctctcctgccctgtgggttttaaaaatggcactaacggtaatgtgaaaatcgcgattgatgcgatccgcgcggccaaagcgtcacattacttctattcaccagataagaatggtcgtatgacggtttaccgtaccagtggtaacccatttggtcatattattctgcgtggtggtgatagcggaccaaactttgatgcggcttcgattaatgaagcttgccagcagttggcgcaattcaacttaccagagcgtttagtggtggatttcagccacgcgaactgtcaaaaacaacaccgtaaacaagtggatgtcgcgcgcgatatttgccagcaaattgaagctggcagccacaaaattgcgggcatcatggcggaaagcttccttgtggaaggcaatcagccaatgcacgatctcaataatctgacttatggtctgtcgatcaccgatccttgtttaggatggaaagataccgccaccatgcttgatatgctggctcaatcgatcaaagtccgtcgttctcgtcattaa

SEQ ID NO: 1508 - protein, 353 aa, Vibrio cholerae
MPLKTDELRTQALGPMPTPAELSHAHPITDEVALRIAQSRRQIESILTGEDDRLLVIVGPCSVHDTDAALDYARRLAALQENYTDELFVVMRTYFEKPRTVVGWKGLITDPNLDGSYALETGLNKARKLLLDVNKLGLATATEFLDMITGQYIADLITWGAIGARTTESQIHREMASALSCPVGFKNGTNGNVKIAIDAIRAAKASHYFYSPDKNGRMTVYRTSGNPFGHIILRGGDSGPNFDAASINEACQQLAQFNLPERLVVDFSHANCQKQHRKQVDVARDICQQIEAGSHKIAGIMAESFLVEGNQPMHDLNNLTYGLSITDPCLGWKDTATMLDMLAQSIKVRRSRH

SEQ ID NO: 1509 - DNA, 942 bp, Neisseria meningitidis
  CDS (1)..(942): transl_table=11
atgacacaccattaccccacagacgatattaagattaaagaagttaaagagttgttgccgccgattgcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcgcgcagcctgttgttgtcgctgaacaatatgggtatgcctgcctctaccgagtttttggatatgattacgccgcaatattatgcggacttgatttcttggggggcaatcggtgcgcggacgaccgaaagccaagttcaccgcgaattggcaagcgggctgtcctgccccgtcggctttaaaaacggtacggacggcaatttgaagattgccatcgacgcaatcggtgcggcgagccattcgcatcatttcctgtctgtaaccaaggccgggcattccgccattgtccataccggcggcaatcctgactgtcatgtcattttgcgcggcggaaaagagccgaattatgatgcgggacacgtcagcgaggcggcggaacaactgcgtgcggcaggggtaaccgacaagctgatgatagattgcagccacgccaacagccgcaaggattacacccggcagatggaagtggcacaagatattgccgcccaattggaacaggacggcggcaatatcatgggcgtgatggtggaaagccatttggtcgaaggcaggcaggactag

SEQ ID NO: 1510 - protein, 313 aa, Neisseria meningitidis
MTHHYPTDDIKIKEVKELLPPIAHLYELPISKEASGLVHRTRQEISDLVHGRDKRLLVIIGPCSIHDPKAALEYAERLLKLRKQYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAGHVSEAAEQLRAAGVTDKLMIDCSHANSRKDYTRQMEVAQDIAAQLEQDGGNIMGVMVESHLVEGRQD

SEQ ID NO: 1511 - DNA, 942 bp, Neisseria gonorrhoeae
  CDS (1)..(942): transl_table=11
atgacacaccattaccccacagacgatattaagattaaagaagttaaagagttgttgccgccgattgcccatctttacgagctgccgatttccaaagaggcttcgggcttggttcaccgcacccgtcaggaaatttccgatttggttcacggcagggacaggcggctgttggtcattatcgggccgtgttcgattcacgatccgaaagcggcgttggaatatgcggaacgtctgttgaaactccgcaagcggtatgaaaacgagcttttgatcgtgatgcgcgtttatttcgagaagccgagaacgacggtgggttggaaaggtttgattaacgacccgcatttggacggtacgttcgacatcaatttcggtttgcgtcaggcgcgcagtctgttgttgtccctgaataatatgggcatgcctgcctctaccgaatttttggatatgattacaccccagtattatgccgacctgatttcttggggggcaatcggcgcgcggacgaccgaaagccaagtccaccgcgaattggcaagcggtctgtcctgccccgtcggctttaaaaacggtacggacggcaatttgaagattgcgatcgacgcaatcggtgcggcgagccattcgcatcatttcttgtctgtaaccaaggccgggcattccgccattgtccataccggcggcaatcccgactgtcatgtcattttgcgcggcggaaaagagccgaattatgatgcgggacacgtcagcgaggcggtggaacaactgcgtgcggcaggggtaaccgacaagctgatgatcgattgcagccacgccaacagccgcaaggattacacccggcagatggaagtggcacaagacattgccgaccaattggaacaggacggcggcaatatcatgggcgtgatggtggaaagccatttggtcgaaggcaggcaggactag

SEQ ID NO: 1512 - protein, 313 aa, Neisseria gonorrhoeae
MTHHYPTDDIKIKEVKELLPPIAHLYELPISKEASGLVHRTRQEISDLVHGRDRRLLVIIGPCSIHDPKAALEYAERLLKLRKRYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAGHVSEAVEQLRAAGVTDKLMIDCSHANSRKDYTRQMEVAQDIADQLEQDGGNIMGVMVESHLVEGRQD

SEQ ID NO: 1513 - DNA, 1107 bp, Candida albicans
  CDS (1)..(1107): transl_table=12
atgtttattacaaacgaacacgttggtgacagaagtcgtatggaagattggagaatccgtggttacgatccattaactcctccagatcttttacaacatgaatacccattaactcctgaatcacagaagattatcgttgaaggtagaaatgctgcttgtgatattttgaacggcaaagaccgaagattgattggaccttgttcgattcatgatcctcaagctgccttggattactgtgaaagattatatcaagcttctgaaaaacacaagggtgaattattgattgttatgagagcatacttggaaaaaccaagaaccacagttggttggaaaggtttaattaacgacccagatatcgatggtaccttccatataaataaggggttgagaattgctagaaagttgtttgttcaattaacttcaaaattaccaattgctggtgaaatgttggatacaatctcacctcaatttttatctgatttattctcagtgggggctattggtgcaagaaccaccgaatcgcaattgcacagagagttggcatctggttatcattcccagttggattcaaaaacggtaccgatggtactttgggtgttgccattgacgcctttgagagctgcttctcatccacatcatttcctttcagtcacaaaacctggtgttgttgctattgttgggactgatgggaaccaagactgttttgttatattaagaggtggtaagaagggtacaaactatgatgccaaatccgtacaagaaacacaagaagaattaatcaaatcaaaagttgttaccgaaatgaaacctggtccaagaattatggttgattgttctcatggtaattctaataaagatcatagaaaccaaccgaaagttgcccaagttgttgctgaacaagtggccggtggtgataaatccatatgtggattaatgattgagagtaatataaatgatggaagacaagatgttccaccaaaggaacaaggtggtaaagatgctttgaaatacggtgtttctattaccgatgcttgtattggttgggaaaccacagaagaagttttggaggttttagccaatgctgtcaaaaccagaagatctttatag

SEQ ID NO: 1514 - protein, 368 aa, Candida albicans
MFITNEHVGDRSRMEDWRIRGYDPLTPPDLLQHEYPLTPESQKIIVEGRNAACDILNGKDRRLIGPCSIHDPQAALDYCERLYQASEKHKGELLIVMRAYLEKPRTTVGWKGLINDPDIDGTFHINKGLRIARKLFVQLTSKLPIAGEMLDTISPQFLSDLFSVGAIGARTTESQLHRELASGYHSQLDSKTVPMVLWVLPLTPLRAASHPHHFLSVTKPGVVAIVGTDGNQDCFVILRGGKKGTNYDAKSVQETQEELIKSKVVTEMKPGPRIMVDCSHGNSNKDHRNQPKVAQVVAEQVAGGDKSICGLMIESNINDGRQDVPPKEQGGKDALKYGVSITDACIGWETTEEVLEVLANAVKTRRSL

SEQ ID NO: 1515 - DNA, 1071 bp, Escherichia coli
  CDS (1)..(1071): transl_table=11
atgcaaaaagacgcgctgaataacgtacatattaccgacgaacaggttttaatgactccggaacaactgaaggccgcttttccattgagcctgcaacaagaagcccagattgctgactcgcgtaaaagcatttcagatattatcgccgggcgcgatcctcgtctgctggtagtatgtggtccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgacggcagtctggcaacagcaattaacgctatgcgcgccgccgcccagccgcaccgttttgttggcattaaccaggcagggcaggttgcgttgctacaaactcaggggaatccggacggccatgtgatcctgcgcggtggtaaagcgccgaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaa

SEQ ID NO: 1516 - protein, 356 aa, Escherichia coli
MQKDALNNVHITDEQVLMTPEQLKAAFPLSLQQEAQIADSRKSISDIIAGRDPRLLVVCGPCSIHDPETALEYARRFKALAAEVSDSLYLVMRVYFEKPRTTVGWKGLINDPHMDGSFDVEAGLQIARKLLLELVNMGLPLATEALDPNSPQYLGDLFSWSAIGARTTESQTHREMASGLSMPVGFKNGTDGSLATAINAMRAAAQPHRFVGINQAGQVALLQTQGNPDGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHQDLNGQLTARVA

SEQ ID NO: 1517 - DNA, 1071 bp, Salmonella typhimurium
  CDS (1)..(1071): transl_table=11
atgcaaaaagacgcgctgaataacgtacgtatcaccgatgaacaggtattaatgacgccggagcagcttaaagcggcctttcccttgagcctggcgcaggaagcgcagatagcgcagtcccggggaatcatttctgacattattgccgggcgcgatccgcgtctgttggtggtatgcggtccttgttctattcacgatcctgaaaccgctctggaatatgcccgtcgatttaaagcccttgccgcagaggtcagcgatagcctctatctggtaatgcgcgtctattttgaaaagccgcgaactaccgtcggctggaaagggctgattaacgatcctcacatggatggctcatttgatgtggaagccgggttgaaaatagcgcgtcagctactggtggaactggtgaatatggggttgccattggcgaccgaagcgttggatccgaacagcccgcaatacctgggcgatctgtttagctggtcggcgataggggcgcgcacaaccgaatcgcaaacccaccgcgaaatggcgtctggtctttctatgccggtcggctttaaaaacggcacggatggcagcctggcgacagcgattaacgccatgcgcgccgctgcgcaacctcatcgttttgttggcattaaccaggccggtcaggttgcgttattgcaaacccagggaaatccgcatggccatgtgattctgcgtggcggcaaagcgccaaactatagcccggcagatgtcgctcagtgtgaaaaagagatggaacaggcgggactacgtccttcgctgatggtagattgcagtcatggtaactccaataaagattatcgccgccagccagccgttgccgaatctgtggttgcgcagattaaagatggcaatcgttcaatcattggcttaatgattgaaagtaatattcatgagggtaaccagtcttccgaacagccgcgcagcgaaatgaagtatggcgtttccgtcaccgatgcttgtattagctgggagatgaccgatgccctgttacgtgaaattcataaagatttgagcggccagctggcggtgcgcgtcgcataa

SEQ ID NO: 1518 - protein, 356 aa, Salmonella typhimurium
MQKDALNNVRITDEQVLMTPEQLKAAFPLSLAQEAQIAQSRGIISDIIAGRDPRLLVVCGPCSIHDPETALEYARRFKALAAEVSDSLYLVMRVYFEKPRTTVGWKGLINDPHMDGSFDVEAGLKIARQLLVELVNMGLPLATEALDPNSPQYLGDLFSWSAIGARTTESQTHREMASGLSMPVGFKNGTDGSLATAINAMRAAAQPHRFVGINQAGQVALLQTQGNPHGHVILRGGKAPNYSPADVAQCEKEMEQAGLRPSLMVDCSHGNSNKDYRRQPAVAESVVAQIKDGNRSIIGLMIESNIHEGNQSSEQPRSEMKYGVSVTDACISWEMTDALLREIHKDLSGQLAVRVA

SEQ ID NO: 1519 - DNA, 1107 bp, Schizosaccharomyces pombe
  CDS (1)..(1107)
atggacaagcacactcctcttcttcctggcgacagtgttttttcacgttgtaaaactgaagatagtcgtatcaaaggctatgatccagtaatttcacctgctttaattcaatcagaattagcagcctctgatgaaacacttgcttttgtgtcggatcaaagacgccaagccgccgatatcattgcgggacgtgatgatagacttcttctaatcgttggaccctgttctttacacgatcctgttgccgccaaggagtatgccattcgcttgcaaaaggaggctattaagcacaagaaggacttgcatattattatgcgcgcctatcttgaaaagcctcgtacaactgttggatggaaagggttgattaatgatcccgatttggatggatcttataacattaataagggtattcgtgtcgctcgacgcatttttctggagcttctggaaactggtgtcggtatagcgtcagagatgctggacactataagtccccaatatttagctgatctaatttgctggggcgctattggtgctcgtaccactgagtcccaattgcatcgagaacttgcttcagggctttcttttccaataggttttaagaatgctactgacggtaacattggtattgctatagatgctatgaattcttctgccaaccctcatcatttcttgtctgtcacaaagcagggtgttgtagccattgttactactacaggtaaccctgatacacacattattttgcgtggtggtaaaagtgggactaacttcgatgctgattcagtggctggtgccaaggctaaactcgaagaatgcaacaagctacctagtatcatgatcgactgttctcatggaaactcatctaaaaaccataagaatcaacccaaggttgctgcttgtattgctgagcaggtggcaaacggtcagaaagcaattactggtgtcatgatcgaatctcaccttaacgaaggtaagcaagctatacctgaggatgatttgtcaagtatgaaatatggagtcagtgtcaccgatgcttgcattggttgggacgacactaccgccgtttttgaacagttggctgctgccgtccgttctcgtcgttctcattaa

SEQ ID NO: 1520 - protein, 368 aa, Schizosaccharomyces pombe
MDKHTPLLPGDSVFSRCKTEDSRIKGYDPVISPALIQSELAASDETLAFVSDQRRQAADIIAGRDDRLLLIVGPCSLHDPVAAKEYAIRLQKEAIKHKKDLHIIMRAYLEKPRTTVGWKGLINDPDLDGSYNINKGIRVARRIFLELLETGVGIASEMLDTISPQYLADLICWGAIGARTTESQLHRELASGLSFPIGFKNATDGNIGIAIDAMNSSANPHHFLSVTKQGVVAIVTTTGNPDTHIILRGGKSGTNFDADSVAGAKAKLEECNKLPSIMIDCSHGNSSKNHKNQPKVAACIAEQVANGQKAITGVMIESHLNEGKQAIPEDDLSSMKYGVSVTDACIGWDDTTAVFEQLAAAVRSRRSH

SEQ ID NO: 1521 - DNA, 1113 bp, Saccharomyces cerevisiae
  CDS (1)..(1113)
atgttcattaaaaacgatcacgccggtgacaggaaacgcttggaagactggagaatcaaaggttatgatccattaacccctccagatctgcttcaacatgaatttccaatttcagccaaaggtgaggaaaacattatcaaggcaagagactccgtctgtgatattttgaatggtaaagatgatcgtttagttatcgtgatcgggccatgttccctacatgaccccaaagccgcttacgattacgctgacagattggctaaaatttcagaaaagttgtcaaaagacttattgattattatgagagcgtatttagaaaaaccaaggactactgttggctggaaagggttgattaacgaccctgatatgaataactcttttcaaatcaataaaggtctacggatttcgagagaaatgttcataaaactggttgaaaaattacccattgctggtgagatgttggataccatttctccgcagtttttgagtgattgtttctccttgggtgccatcggcgccagaactactgaatcccaactgcacagagaattagcatccggtctatctttccctattggatttaagaacggtactgatggtggtttgcaagtcgccatcgacgctatgagagccgctgcacatgaacattacttcctttctgtcacaaagccaggtgtcactgctatcgtgggcactgaaggtaacaaggataccttcctgatcttgagaggtggtaagaacggtactaactttgacaaagaaagtgttcaaaatactaagaaacagttagaaaaggccggtttgactgatgattcccagaaaagaattatgatcgattgttcccacggcaacagtaataaagatttcaagaaccaaccaaaggttgccaaatgtatttatgaccagctgacggagggtgagaatagtctctgtggtgttatgattgagtccaacataaatgaaggtagacaagatattcccaaagaaggtggcagagagggattgaagtatggttgttctgttacggatgcttgtattggctgggagtccaccgaacaggtattggagctattggcagaaggtgttagaaacagaagaaaggccttgaaaaaatag

SEQ ID NO: 1522 - protein, 370 aa, Saccharomyces cerevisiae
MFIKNDHAGDRKRLEDWRIKGYDPLTPPDLLQHEFPISAKGEENIIKARDSVCDILNGKDDRLVIVIGPCSLHDPKAAYDYADRLAKISEKLSKDLLIIMRAYLEKPRTTVGWKGLINDPDMNNSFQINKGLRISREMFIKLVEKLPIAGEMLDTISPQFLSDCFSLGAIGARTTESQLHRELASGLSFPIGFKNGTDGGLQVAIDAMRAAAHEHYFLSVTKPGVTAIVGTEGNKDTFLILRGGKNGTNFDKESVQNTKKQLEKAGLTDDSQKRIMIDCSHGNSNKDFKNQPKVAKCIYDQLTEGENSLCGVMIESNINEGRQDIPKEGGREGLKYGCSVTDACIGWESTEQVLELLAEGVRNRRKALKK

SEQ ID NO: 1523 - DNA, 1113 bp, Candida albicans
  CDS (1)..(1113): transl_table=12
atgagtaaaactcctgttcctaccgaatacgacgacacaagaatattgggttacgatcctttagttccaccagccttattacaacacgaaataaaggcatctgccgaatcattggatgttgttataaaaggccgttacgattctgcccaaatccttaagggtaatgatgacagatgtattgtaattgttggtccatgttcaattcacgatcctccacaagccttagaatatggtaaacgtttgaagaaattggctgatgaattaaaagatgacttggtgattatcatgagagcttatttggaaaaaccaagaactaccgttggttggaaaggtttgatcaatgatcctgatgttgataattcttttgatattaaccgtgggttgaagatatctcgtcaattatattccgatttgactagtgttgttggattaccaattggatcagaaatgttagacaccatttctccacaatacttttccgatttcttgagttttggggccattggagctagaaccaccgaatcacaattacacagagaattagcttctggtttaagcttcccaattggatttaaaaatggtaccgatggtggtttagccgttgccttggatgccgtgcaagcttcttcaaaaggacatcacttcatgggtgtcaccaaaaacggtatggctgccattaccactactaaaggtaacgattgttgtttcattatattaagaggtggtaaaaaaatcaccaattacgatgttgaatcagttaaagctgctaaagaagctattgccaaatgtaccgatccaagtatcaagttgatggttgattgctctcacgacaactcaagaaaagactacagaaaccaacctcaagtattagacagtgttgctgaacaaataagtaatggtgaagactccattattggggttatgattgaatccaatattcatgaaggtaaacaaccaatgcccccagcaggtagtggtaaagaagcattgaaatacggtgtgtctatcaccgatggatgtgtttcttgggaaaccactgttgaaatgttgaccaaattgagtcaagcagtccaaactagaagaagtttaaagaaacaaaaagtttccaattaa

SEQ ID NO: 1524 - protein, 370 aa, Candida albicans
MSKTPVPTEYDDTRILGYDPLVPPALLQHEIKASAESLDVVIKGRYDSAQILKGNDDRCIVIVGPCSIHDPPQALEYGKRLKKLADELKDDLVIIMRAYLEKPRTTVGWKGLINDPDVDNSFDINRGLKISRQLYSDLTSVVGLPIGSEMLDTISPQYFSDFLSFGAIGARTTESQLHRELASGLSFPIGFKNGTDGGLAVALDAVQASSKGHHFMGVTKNGMAAITTTKGNDCCFIILRGGKKITNYDVESVKAAKEAIAKCTDPSIKLMVDCSHDNSRKDYRNQPQVLDSVAEQISNGEDSIIGVMIESNIHEGKQPMPPAGSGKEALKYGVSITDGCVSWETTVEMLTKLSQAVQTRRSLKKQKVSN

SEQ ID NO: 1525 - DNA, 1101 bp, Corynebacterium glutamicum
  CDS (1)..(1101): transl_table=11
atgagttctccagtctcactcgaaaacgcggcgtcaaccagcaacaagcgcgtcgtggctttccacgagctgcctagccctacagatctcatcgccgcaaacccactgacaccaaagcaggcttccaaggtggagcaggatcgccaggacatcgctgatatcttcgctggcgacgatgaccgcctcgttgtcgttgtgggaccttgctcagttcacgatcctgaagcagccatcgattacgcaaaccgcctggctccgctggcaaagcgccttgatcaggacctcaagattgtcatgcgcgtgtacttcgagaagcctcgcaccatcgtcggatggaagggattgatcaatgatcctcacctcaacgaaacctacgacatcccagagggcttgcgcattgcgcgcaaagtgcttatcgacgttgtgaaccttgatctcccagtcggctgcgaattcctcgaaccaaacagccctcagtactacgccgacactgtcgcatggggagcaatcggcgctcgtaccaccgaatctcaggtgcaccgccagctggcttctgggatgtctatgccaattggtttcaagaacggaactgacggaaacatccaggttgcagtcgacgcggtacaggctgcccagaacccacacttcttcttcggaacctccgacgacggcgcgctgagcgtcgtggagaccgcaggcaacagcaactcccacatcattttgcgcggcggtacctccggcccgaatcatgatgcagcttcggtggaggccgtcgtcgagaagcttggtgaaaacgctcgtctcatgatcgatgcttcccatgctaactccggcaaggatcatatccgacaggttgaggttgttcgtgaaatcgcagagcagatttctggcggttctgaagctgtggctggaatcatgattgagtccttcctcgttggtggcgcacagaaccttgatcctgcgaaattgcgcatcaatggcggtgaaggcctggtgtacggacagtctgtgaccgataagtgcatcgatattgacaccaccatcgatttgctcgctgagctggccgcagcagtaagggaacgccgagcagcagccaagtaa

SEQ ID NO: 1526 - protein, 366 aa, Corynebacterium glutamicum
MSSPVSLENAASTSNKRVVAFHELPSPTDLIAANPLTPKQASKVEQDRQDIADIFAGDDDRLVVVVGPCSVHDPEAAIDYANRLAPLAKRLDQDLKIVMRVYFEKPRTIVGWKGLINDPHLNETYDIPEGLRIARKVLIDVVNLDLPVGCEFLEPNSPQYYADTVAWGAIGARTTESQVHRQLASGMSMPIGFKNGTDGNIQVAVDAVQAAQNPHFFFGTSDDGALSVVETAGNSNSHIILRGGTSGPNHDAASVEAVVEKLGENARLMIDASHANSGKDHIRQVEVVREIAEQISGGSEAVAGIMIESFLVGGAQNLDPAKLRINGGEGLVYGQSVTDKCIDIDTTIDLLAELAAAVRERRAAAK

SEQ ID NO: 1527 - DNA, 1089 bp, Haemophilus influenzae
  CDS (1)..(1089): transl_table=11
atggctaaagagaaaattgaaattgtcgtggcaaacgacgatacgcgaattgaaaaagtcgatcaggtgttaccacccattgccttattagaaaaatacccagcaagtgaacaggctgcggcgttagtgaagcaaactcgtcatgaggcacataatattattcatggtaaagatgatcgtttattagtcgtgattgggccttgctctattcatgatccgaaagcagccattgaatatgcgactcgtttaaaaccattacgtgaaaaatacaaagatagccttgaaattattatgcgtgtgtattttgagaaaccgcgtacaacggtgggttggaaaggtttaattaatgaaccatatttgaatgatacttatcgtttaaatgatgggttacgtattgcacggaaattactttcagatattaatgatcttggtgtgcctgcagcgggcgagtttttagatatgattacacctcagtatttggcagattttatgagctggggggcgattggggctagaacaacagaatcacaagttcatcgtgagttggcttcaggtttatcttgtgctgttgggtttaaaaatgccactaatggtggtgtgaaagtcgctttagatgcaattggtgcagcggaagctcctcactatttcttatctgtcactaaatttggtcattctgcaattgtttctacaaaagggaatgaagattgccatattattttacgaggtggagataaaggccctaactatagtgctgaagatgtagaaaaagtttgtgctgatattgaaaaaacagggcgtattccacacgttatggttgattttagccatgcaaacagcagtaaacaatataaaaagcaaatggatgtttgccaagacgtatgtaatcagattgcatttggttctaaacaaatctttggcgtaatggtggaaagccatttagtggaaggtcgtcaagatttagttgatggcaaagcacagacttatggacaaagtattacggatgcgtgcattggatgggaagattctgaaagattattgcaacaactttctgatgcagttattgctagacgtaaagcgacgagtaattaa

SEQ ID NO: 1528 - protein, 362 aa, Haemophilus influenzae
MAKEKIEIVVANDDTRIEKVDQVLPPIALLEKYPASEQAAALVKQTRHEAHNIIHGKDDRLLVVIGPCSIHDPKAAIEYATRLKPLREKYKDSLEIIMRVYFEKPRTTVGWKGLINEPYLNDTYRLNDGLRIARKLLSDINDLGVPAAGEFLDMITPQYLADFMSWGAIGARTTESQVHRELASGLSCAVGFKNATNGGVKVALDAIGAAEAPHYFLSVTKFGHSAIVSTKGNEDCHIILRGGDKGPNYSAEDVEKVCADIEKTGRIPHVMVDFSHANSSKQYKKQMDVCQDVCNQIAFGSKQIFGVMVESHLVEGRQDLVDGKAQTYGQSITDACIGWEDSERLLQQLSDAVIARRKATSN

SEQ ID NO: 1529 - DNA, 1113 bp, Saccharomyces cerevisiae
  CDS (1)..(1113)
atgagtgaatctccaatgttcgctgccaacggcatgccaaaggtaaatcaaggtgctgaagaagatgtcagaattttaggttacgacccattagcttctccagctctccttcaagtgcaaatcccagccacaccaacttctttggaaactgccaagagaggtagaagagaagctatagatattattaccggtaaagacgacagagttcttgtcattgtcggtccttgttccatccatgatctagaagccgctcaagaatacgctttgagattaaagaaattgtcagatgaattaaaaggtgatttatccatcattatgagagcatacttggagaagccaagaacaaccgtcggctggaaaggtctaattaatgaccctgatgttaacaacactttcaacatcaacaagggtttgcaatccgctagacaattgtttgtcaacttgacaaatatcggtttgccaattggttctgaaatgcttgataccatttctcctcaatacttggctgatttggtctccttcggtgccattggtgccagaaccaccgaatctcaactgcacagagaattggcctccggtttgtctttcccagttggtttcaagaacggtaccgatggtaccttaaatgttgctgtggatgcttgtcaagccgctgctcattctcaccatttcatgggtgttactaagcatggtgttgctgctatcaccactactaagggtaacgaacactgcttcgttattctaagaggtggtaaaaagggtaccaactacgacgctaagtccgttgcagaagctaaggctcaattgcctgccggttccaacggtctaatgattgactactctcacggtaactccaataaggatttcagaaaccaaccaaaggtcaatgacgttgtttgtgagcaaatcgctaacggtgaaaacgccattaccggtgtcatgattgaatcaaacatcaacgaaggtaaccaaggcatcccagccgaaggtaaagccggcttgaaatatggtgtttccatcactgatgcttgtataggttgggaaactactgaagacgtcttgaggaaattggctgctgctgtcagacaaagaagagaagttaacaagaaatag

SEQ ID NO: 1530 - protein, 370 aa, Saccharomyces cerevisiae
MSESPMFAANGMPKVNQGAEEDVRILGYDPLASPALLQVQIPATPTSLETAKRGRREAIDIITGKDDRVLVIVGPCSIHDLEAAQEYALRLKKLSDELKGDLSIIMRAYLEKPRTTVGWKGLINDPDVNNTFNINKGLQSARQLFVNLTNIGLPIGSEMLDTISPQYLADLVSFGAIGARTTESQLHRELASGLSFPVGFKNGTDGTLNVAVDACQAAAHSHHFMGVTKHGVAAITTTKGNEHCFVILRGGKKGTNYDAKSVAEAKAQLPAGSNGLMIDYSHGNSNKDFRNQPKVNDVVCEQIANGENAITGVMIESNINEGNQGIPAEGKAGLKYGVSITDACIGWETTEDVLRKLAAAVRQRREVNKK

SEQ ID NO: 1531 - DNA, 1047 bp, Buchnera aphidicola subsp
  CDS (1)..(1047): transl_table=11
atgaaaaaaacagatgaactacgtacaatacgaattgatccattaataactccagctgaattagcaaggcagtacgcgatcacttcagacatcatggacactgttatcgcaacaagacaaaatattgctcgtattatgactggacaagatgcgcgactacttgttgtaataggaccatgttcagttcatgatcctatcgcagcagtagaatatgcacatcgattgtatgaattacgagtaaaatataaagatcgtcttgaaattataatgcgtacatattttgaaaaaccaagaacagttgttggatggaaagggctgatttctgatccagatttaaatggtagttttcgagttaatcatggattagccgtagcacgtaaattattattagatattaatgcattaggaatgcctgcagcaacagagtttctcgatatagttataggacaatttatagcagatttaattagttggggtgctattggagcaagaactactgaaagtcaaattcatagagaaatggcttccgctctttcctgtccagtaggttttaaaaatggaactgacggtaatatacgcattgcaattgatgctattcgcgcagctaaagttagacatttatttttcgcgcctaataaagatggtcaaatgacgattaatcataccagtggcaatccatatgggcatataatcatgcgaggtggtcgtgcgccgaattaccatcctgatgatattaactcagcagtaaagcatttacgtgaatttgatctattagaacatttaatgattgattttagtcacggtaattgtttaaaagaacatcttcgtcaaaaaaatgtttctaagtctgtttcatatcaaatttctcatggttcgaaagctatttttggtgttatgattgaaagctttttagaagaaggttttcaaacagtaacgaataatcaaccattaatatatggtaaatcgattactgatgcctgtttaaattggaaagacagtgttttaattatcgaacaattagcagatgccgtagatgctcgtttttaa

SEQ ID NO: 1532 - protein, 348 aa, Buchnera aphidicola subsp
MKKTDELRTIRIDPLITPAELARQYAITSDIMDTVIATRQNIARIMTGQDARLLVVIGPCSVHDPIAAVEYAHRLYELRVKYKDRLEIIMRTYFEKPRTVVGWKGLISDPDLNGSFRVNHGLAVARKLLLDINALGMPAATEFLDIVIGQFIADLISWGAIGARTTESQIHREMASALSCPVGFKNGTDGNIRIAIDAIRAAKVRHLFFAPNKDGQMTINHTSGNPYGHIIMRGGRAPNYHPDDINSAVKHLREFDLLEHLMIDFSHGNCLKEHLRQKNVSKSVSYQISHGSKAIFGVMIESFLEEGFQTVTNNQPLIYGKSITDACLNWKDSVLIIEQLADAVDARF

SEQ ID NO: 1533 - DNA, 1047 bp, Buchnera aphidicola subsp
  CDS (1)..(1047): transl_table=11
atgaaaaaaacagatgaactacgtacaatacgaattgatccattgataacaccatctgaattagcaaaaaaatatgctattacttcagaaatcatggataatgttattataacgagacaaaatatagctcgaattatgactggagaagatttgcgtttgcttgttgtaataggtccatgttcagtacatgatccaattgcagcagttgaatatgctcatcgattatatgaactacgtaaaaaatatcaagatcgtcttgaaattataatgcgtacatattttgaaaaaccaagaacagtagttggttggaagggattaatttcagatccagatttaaatggtagtttcagagttaatcatggtttagctgttgcacgtaaattattattagatatcaatgaactaggaatgcctgcagcaacagagtttttagatatggtaatagggcaatttattgcggatttaattagctggggtgcgattggagctagaactactgaaagtcaaattcatagagaaatggcttcagctctttcttgtccagtaggttttaaaaatggaacagatggaaatatacgtattgcaattgatgctattagagcagcacaagcacgtcatttgttttttgctccgaataaagatggacaaatgactattaatcataccagtggaaatccttatggacatataattatgagaggtggtcgaactcctaattatcatgctcacgatattaattcagcaatagaacatttacgtgaatttaatttgttagaacatttaatgattgattttagtcatggtaattgtttaaaggaacatattcgtcaaaaagatgttgctaaatctgtttcaaaacaaatttctcaaggttcaaaaactatatttggtgtaatgattgaaagttttttagaagaaggttttcaaacagttaaagaaaatcaaccactaatatatggaaaatcaattactgatgcatgtttaaattggaaagacagtgtccttattattaagcaattagcagatgcggtagatactcgtttttaa

SEQ ID NO: 1534 - protein, 348 aa, Buchnera aphidicola subsp
MKKTDELRTIRIDPLITPSELAKKYAITSEIMDNVIITRQNIARIMTGEDLRLLVVIGPCSVHDPIAAVEYAHRLYELRKKYQDRLEIIMRTYFEKPRTVVGWKGLISDPDLNGSFRVNHGLAVARKLLLDINELGMPAATEFLDMVIGQFIADLISWGAIGARTTESQIHREMASALSCPVGFKNGTDGNIRIAIDAIRAAQARHLFFAPNKDGQMTINHTSGNPYGHIIMRGGRTPNYHAHDINSAIEHLREFNLLEHLMIDFSHGNCLKEHIRQKDVAKSVSKQISQGSKTIFGVMIESFLEEGFQTVKENQPLIYGKSITDACLNWKDSVLIIKQLADAVDTRF

SEQ ID NO: 1535 - DNA, 1047 bp, Buchnera aphidicola subsp
  CDS (1)..(1047): transl_table=11
atgaaaaaaacagatgaattgcgaacaatacgcattgacccgttagttactccagctgaattagcacaacgtcatgttataactccttcaattatggatactgttatttcaacgagaaaaaatattgctaatattatgacgggattagatcctcgtttacttgtcattataggaccttgttcagtacatgatcctgttgctgcagtagaatatgctggaagattacaagtattgcgtaagaaatatgaatcgcgtcttgaaattgttatgcgaacttattttgaaaaacctcgtacagtaataggttggaaggggctaatttcagatcctgaccttaatggtagctttcacgtaaataatggtttatcgatagctagaaaattattgttggacattaataagttaggagttccagctgcgactgaatttttagacatggtaataggacaatttattgctgatctcattagttggggcgctattggtgcgcgtactactgaaagtcaaattcatcgtgaaatggcatcagcattatcttgtcctgtaggttttaaaaatggtacggatggtaatataagaattgctgtagatgctattcgtgctgctagtgtagaacatttatttttagcgcctaacaaatatggtcaaatgactattaattataccagtggaaatcccttcggtcatgttattatgcgcggtggaaaatctccaaattatcatgctaaagatattgctattgcaataaaatacttacacgaatttactctttcagagtatttgatgatagactttagtcatggaaattgtttaaaacaacatcgtcgtcaattagatgtgggtgaatctattgctaagcagataagagatggatcaacagctatttttggtgttatgattgaaagttttttagaagaaggttctcaaaaagttattgacaataaatctttagtatatggaaaatctattactgatccttgtttgggttggaatgatagtgcatttttacttgaaaagttggcaaatgctgttgatagtagattttaa

SEQ ID NO: 1536 - protein, 348 aa, Buchnera aphidicola subsp
MKKTDELRTIRIDPLVTPAELAQRHVITPSIMDTVISTRKNIANIMTGLDPRLLVIIGPCSVHDPVAAVEYAGRLQVLRKKYESRLEIVMRTYFEKPRTVIGWKGLISDPDLNGSFHVNNGLSIARKLLLDINKLGVPAATEFLDMVIGQFIADLISWGAIGARTTESQIHREMASALSCPVGFKNGTDGNIRIAVDAIRAASVEHLFLAPNKYGQMTINYTSGNPFGHVIMRGGKSPNYHAKDIAIAIKYLHEFTLSEYLMIDFSHGNCLKQHRRQLDVGESIAKQIRDGSTAIFGVMIESFLEEGSQKVIDNKSLVYGKSITDPCLGWNDSAFLLEKLANAVDSRF

SEQ ID NO: 1537 - DNA, 1047 bp, Escherichia coli O157
  CDS (1)..(1047): transl_table=11
atgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactcaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccagatttaaacggcagctatcggataaatcacggtctggagctggcgcgcaaattacttttacaggtaaatgagctgggcgtcccaaccgcgactgagttcctcgatatggtgaccggtcagtttattgctgatttaatcagttggggcgcgattggcgcacgtactaccgaaagtcagatccaccgtgaaatggcttcggcactctcctgtccggtaggttttaaaaatggtaccgatggcaatacgcggattgctgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcggtcagccgctcacttacggtcaatccattaccgacccgtgtctgggctgggaagataccgaacgcctggtcgaaaaactagcctctgcggtagatacccgcttctga

SEQ ID NO: 1538 - protein, 348 aa, Escherichia coli O157
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRINHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTAIAGIMAESFLREGTQKIVGGQPLTYGQSITDPCLGWEDTERLVEKLASAVDTRF

SEQ ID NO: 1539 - DNA, 1047 bp, Escherichia coli O6
  CDS (1)..(1047): transl_table=11
atgaacagaactgacgaactccgtactgcgcgtattgagagcctggtaacgcccgccgaactcgcgctacggtatcccgtaacgcctggcgtcgccacccatgtcaccgactcccgccgtagaattgaaaaaatactgaatggtgaagataagcgactgttggtcattattggcccctgctcgatccacgatctcaccgctgcgatggagtacgccacccgtctgcagtcgctgcgcaaccagtaccagtcacggctggaaatcgtaatgcgcacctattttgaaaaaccacgaacggttgtcggctggaaaggactcatctccgatccagatttaaacggtagctatcgggtaaatcacggtctggagctggcgcgcaaattacttttacaggtaaatgagctgggcgtccctaccgcgactgagttcctcgatatggtgaccggtcagtttattgctgatttaatcagttggggtgcgattggcgcacgtactaccgaaagtcagatccaccgcgaaatggcttcggcactctcctgtccggtgggttttaaaaatggtaccgatggcaacacgcggattgccgtggatgctatccgcgcagcccgcgccagccatatgttcctctcgccagacaaaaatggtcagatgaccatctatcagaccagcggcaacccgtatggccacattattatgcgtggtggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcggtcagccgctcacttacggtcaatccattaccgacccgtgtctgggctgggaagataccgaacgcctggtcgaaaaactcgcctctgcggtagatactcgcttctga

SEQ ID NO: 1540 - protein, 348 aa, Escherichia coli O6
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRVNHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTAIAGIMAESFLREGTQKIVGGQPLTYGQSITDPCLGWEDTERLVEKLASAVDTRF

SEQ ID NO: 1541 - DNA, 1047 bp, Escherichia coli
  CDS (1)..(1047): transl_table=11
atgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccagatttaaacggcagctatcgggtaaatcacggtctggagctggcgcgcaaattacttttacaggtaaatgagctgggcgtcccaaccgcgaccgagttcctcgatatggtgaccggtcagtttattgctgatttaatcagttggggcgcgattggcgcacgtactaccgaaagtcagatccaccgcgaaatggcttcggcactctcctgtccggtaggttttaaaaatggtaccgatggcaatacgcggattgctgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcagtcagccgctcacttacggtcaatccattaccgacccgtgtctgggctgggaggataccgaacgcctggtcgaaaaactcgcctctgcggtagatacccgcttctga

SEQ ID NO: 1542 - protein, 348 aa, Escherichia coli
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRVNHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTAIAGIMAESFLREGTQKIVGSQPLTYGQSITDPCLGWEDTERLVEKLASAVDTRF

SEQ ID NO: 1543 - DNA, 1047 bp, Enterobacter agglomerans
  CDS (1)..(1047): transl_table=11
atgaacaaaaccgacgaactgcgtaccgcacgcattggtagtctgattaccccccccagcctggcggctgagcatcctgtctctccggcaattgccgacaatgtcaccgctgcccgtaaacgtattgcctgtattctgacgggtgaagatcaccgcctgctggtggtgattggcccctgctcgctgcacgacccgaaagcggcactggaatatgctgagcgtctgaacgcgttacgccgccgctatgaagatcggctggagattgtgatgcgcgcctactttgaaaagccgcgcaccgtagtgggctggaaaggcttaatctccgatccggatctggatgggagctacgatgtgaaccgcggcataggcatcgcccgccagctgctgattgatatcaacgcgctgggcctgcctaccgccacggaattcctggatatggtgatcggccagtttattgccgatctgattagctggggcgcgattggcgcacgcaccaccgaaagccagatccaccgcgaaatggcatcggccctctcctgcccggtcggctttaaaaacggcaccgatggtaacgtacagattgccgtggatgcgattcgcgccgcgcgcgccagccacatgttcctttcgcccgataagctgggccagatgactatctatcagaccagcggcaacccgcatggtcatgtgatcctgcgtggcggcaaacagcctaactatcatgccagtgatgtcgccgccgcagccgaaagtctgtcggcgtttaatctgccacagcagctggtgatcgacttcagtcacggtaactgcctgaagcagcatcgtcgtcagatggatgtcgcggcagaggtggcagaacagattaaagcgggatcgcaggccgttgccggtgtgatgattgaaagcttcctggaagagggcaatcagaaagtcgtcagcggcgaaccgctggtctatggcaagtcgattaccgatccctgcctcggctggcaggagagcgaaaaggtgctcgccctgctggccgaggcggtttctcaccgcctctga

SEQ ID NO: 1544 - protein, 348 aa, Enterobacter agglomerans
MNKTDELRTARIGSLITPPSLAAEHPVSPAIADNVTAARKRIACILTGEDHRLLVVIGPCSLHDPKAALEYAERLNALRRRYEDRLEIVMRAYFEKPRTVVGWKGLISDPDLDGSYDVNRGIGIARQLLIDINALGLPTATEFLDMVIGQFIADLISWGAIGARTTESQIHREMASALSCPVGFKNGTDGNVQIAVDAIRAARASHMFLSPDKLGQMTIYQTSGNPHGHVILRGGKQPNYHASDVAAAAESLSAFNLPQQLVIDFSHGNCLKQHRRQMDVAAEVAEQIKAGSQAVAGVMIESFLEEGNQKVVSGEPLVYGKSITDPCLGWQESEKVLALLAEAVSHRL

SEQ ID NO: 1545 - DNA, 1047 bp, Salmonella typhi
  CDS (1)..(1047): transl_table=11
atgaacagaaccgacgaactccgtactgcgcgtatcgacagcctggtaacaccaaccgaactcgcgcagcggtatcctgtatcgtcctccgtcgccagtcacgttaccgactcccgacgccggatagaaaagattttaaatggtgaagatccacggctactggtcgtcattggcccctgttcgattcacgatctgaatgctgccatggaatacgcgacgcagctccaggcacaacgccaaaagcatcaggcgcgtctggaaatcgtcatgcgcacctattttgaaaaaccgcgcaccgtcgtgggatggaaaggcctgatttccgatcccgacttgaatggcagttaccgcgtcaatcatgggcttgaactggcgcgtcgcttgctattgcaggtgaacgaactgggagtaccgaccgccacagaatttcttgatatggtcaccggccagtttattgccgatctgatcagttggggaacgattggcgcgcgtaccaccgaaagccaaatccatcgggaaatggcttctgcgctctcttgcccggtcggctttaaaaatggtacggatggcaatacccgcattgccgttgatgctattcgcgcctcccgcgccagtcatatgtttctctcgccggataaagacggacagatgactatctaccaaacgagtggcaacccgtatgggcacatcatcatgcgcggcggtaaaaaaccgaactaccacgctgaagatattgccgccgcctgcgacacgttgcatgaatttgatctgccggaacatctggtcgtcgacttcagccacggcaactgtcaaaaacagcatcgccgccagttggacgtatgtgatgatatttgccagcagattcgtaatggctccacggcaattgccgggattatggcagagagttttttacgggaaggcacgcaaaaaattatcagcggtcaaccgttaatctatggtcaatccattaccgatccctgcctgaactgggaagatacggaagttctgttggaaaaacttgccgcggcggtagacagccgcttttaa

SEQ ID NO: 1546 - protein, 348 aa, Salmonella typhi
MNRTDELRTARIDSLVTPTELAQRYPVSSSVASHVTDSRRRIEKILNGEDPRLLVVIGPCSIHDLNAAMEYATQLQAQRQKHQARLEIVMRTYFEKPRTVVGWKGLISDPDLNGSYRVNHGLELARRLLLQVNELGVPTATEFLDMVTGQFIADLISWGTIGARTTESQIHREMASALSCPVGFKNGTDGNTRIAVDAIRASRASHMFLSPDKDGQMTIYQTSGNPYGHIIMRGGKKPNYHAEDIAAACDTLHEFDLPEHLVVDFSHGNCQKQHRRQLDVCDDICQQIRNGSTAIAGIMAESFLREGTQKIISGQPLIYGQSITDPCLNWEDTEVLLEKLAAAVDSRF

SEQ ID NO: 1547 - DNA, 1047 bp, Salmonella typhimurium
  CDS (1)..(1047): transl_table=11
atgaacagaaccgacgaactccgtactgcgcgtatcgacagcctggtaacaccgaccgaactcgcgcagcggtatcctgtatcgtcctccgtcgccagtcacgttaccgactcccgacgccggatagaaaagattttaaatggtgaagatccacggctactggtcgtcattggcccctgttcgattcacgatctgaatgctgccatggaatacgcgacgcagctccaggcacaacgccaaaagcatcaggcgcgtctggagatcgtcatgcgcacctattttgaaaaaccgcgcaccgtcgtgggatggaaaggcctgatttccgatcccgacttgaatggcagttaccgcgtcaattatgggcttgaactggcgcgtcgcttgctattgcaggtgaacgaactgggagtaccgaccgccacagagtttcttgatatggtcaccggccagtttattgccgatctgatcagttggggagcgattggcgcgcgtaccaccgaaagccaaatccatcgggaaatggcttctgcgctctcttgtccggtcggctttaaaaatggtacggatggcaatacccgcattgccgttgatgctattcgcgcctcccgcgccagtcatatgtttctctcgccggataaagacggacagatgactatctaccagacgagtggcaacccgtatgggcacatcatcatgcgcggcggtaaaaaaccgaactaccacgctgaagatattgccgccgcctgcgatacgttgcatgaatttgatctgccggaacatctggtcgtcgacttcagccacggcaactgtcaaaaacagcatcgccgccagttagaggtatgtgatgatatttgccagcagattcgtaatggctccacggcaattgccgggattatggcagagagttttttacgggaaggcacgcaaaaaattatcagcggtcaaccattaatctatggtcagtccattaccgatccttgcctgaactgggaagatacggaagttttgttggaaaaacttgccgcggcggtagacagccgcttttaa

SEQ ID NO: 1548 - protein, 348 aa, Salmonella typhimurium
MNRTDELRTARIDSLVTPTELAQRYPVSSSVASHVTDSRRRIEKILNGEDPRLLVVIGPCSIHDLNAAMEYATQLQAQRQKHQARLEIVMRTYFEKPRTVVGWKGLISDPDLNGSYRVNYGLELARRLLLQVNELGVPTATEFLDMVTGQFIADLISWGAIGARTTESQIHREMASALSCPVGFKNGTDGNTRIAVDAIRASRASHMFLSPDKDGQMTIYQTSGNPYGHIIMRGGKKPNYHAEDIAAACDTLHEFDLPEHLVVDFSHGNCQKQHRRQLEVCDDICQQIRNGSTAIAGIMAESFLREGTQKIISGQPLIYGQSITDPCLNWEDTEVLLEKLAAAVDSRF

SEQ ID NO: 1549 - DNA, 1047 bp, Shigella flexneri
  CDS (1)..(1047): transl_table=11
atgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaagggctaatctccgatccggatttaaacggcagctatcgggtaaatcacggtctggagctggcgcgcaaattacttttacaggtaaatgagctgggtgtccctaccgcgactgagttcctcgatatggtaaccggtcagtttattgctgatttaatcagttggggcgcgattggcgctcgtactaccgaaagtcagatccaccgcgaaatggcttcagcactctcctgtccggtaggttttaaaaatggtaccgatggcaacacgcggattgccgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggagattgctggaattatggcggaaagtttcctgcgcgaaggaacgcaaaaaatcgtcggcggtcagccgctcacttacggtcaatccattaccgacccgtgtctgggctgggaagataccgaacgcctggtcgaaaaactcgcctttgcggtagatacccgcttctga

SEQ ID NO: 1550 - protein, 348 aa, Shigella flexneri
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRVNHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTEIAGIMAESFLREGTQKIVGGQPLTYGQSITDPCLGWEDTERLVEKLAFAVDTRF

SEQ ID NO: 1551 - DNA, 25 bp, Artificial sequence
  primer
atgaattatcagaacgacgatttac

SEQ ID NO: 1552 - DNA, 22 bp, Artificial sequence
  primer
ttacccgcgacgcgcttttact

SEQ ID NO: 1553 - protein, 357 aa, Artificial sequence
  consensus sequence
  Variant (2)..(3): Xaa in position 2 to 3 is any amino acid
  Variant (5)..(11): Xaa in position 5 to 11 is any amino acid
  Variant (13)..(24): Xaa in position 13 to 24 is any amino acid
  Variant (25)..(25): Xaa in position 25 is any or no amino acid
  Variant (27)..(31): Xaa in position 27 to 31 is any amino acid
  Variant (33)..(34): Xaa in position 33 to 34 is any amino acid
  Variant (36)..(36): Xaa in position 36 is any amino acid
  Variant (38)..(38): Xaa in position 38 is any amino acid
  Variant (39)..(41): Xaa in position 39 to 41 is any or no amino acid
  Variant (44)..(44): Xaa in position 44 is any amino acid
  Variant (46)..(47): Xaa in position 46 to 47 is any amino acid
  Variant (52)..(52): Xaa in position 52 is any amino acid
  Variant (55)..(56): Xaa in position 55 to 56 is any amino acid
  Variant (59)..(60): Xaa in position 59 to 60 is any amino acid
  Variant (63)..(64): Xaa in position 63 to 64 is any amino acid
  Variant (66)..(74): Xaa in position 66 to 74 is any amino acid
  Variant (75)..(77): Xaa in position 75 to 77 is any or no amino acid
  Variant (79)..(80): Xaa in position 79 to 80 is any amino acid
  Variant (84)..(84): Xaa in position 84 is any amino acid
  Variant (92)..(93): Xaa in position 92 to 93 is any amino acid
  Variant (94)..(94): Xaa in position 94 is any or no amino acid
  Variant (104)..(107): Xaa in position 104 to 107 is any amino acid
  Variant (108)..(113): Xaa in position 108 to 113 is any or no amino acid
  Variant (116)..(118): Xaa in position 116 to 118 is any amino acid
  Variant (120)..(120): Xaa in position 120 is any amino acid
  Variant (122)..(129): Xaa in position 122 to 129 is any amino acid
  Variant (130)..(131): Xaa in position 130 to 131 is any or no amino acid
  Variant (133)..(135): Xaa in position 133 to 135 is any amino acid
  Variant (137)..(137): Xaa in position 137 is any amino acid
  Variant (140)..(142): Xaa in position 140 to 142 is any amino acid
  Variant (146)..(147): Xaa in position 146 to 147 is any amino acid
  Variant (149)..(151): Xaa in position 149 to 151 is any amino acid
  Variant (153)..(153): Xaa in position 153 is any amino acid
  Variant (164)..(164): Xaa in position 164 is any amino acid
  Variant (167)..(168): Xaa in position 167 to 168 is any amino acid
  Variant (174)..(174): Xaa in position 174 is any amino acid
  Variant (176)..(176): Xaa in position 176 is any amino acid
  Variant (183)..(183): Xaa in position 183 is any amino acid
  Variant (185)..(188): Xaa in position 185 to 188 is any amino acid
  Variant (190)..(191): Xaa in position 190 to 191 is any amino acid
  Variant (193)..(195): Xaa in position 193 to 195 is any amino acid
  Variant (197)..(199): Xaa in position 197 to 199 is any amino acid
  Variant (201)..(201): Xaa in position 201 is any amino acid
  Variant (203)..(208): Xaa in position 203 to 208 is any amino acid
  Variant (210)..(211): Xaa in position 210 to 211 is any amino acid
  Variant (212)..(215): Xaa in position 212 to 215 is any or no amino acid
  Variant (217)..(217): Xaa in position 217 is any amino acid
  Variant (220)..(222): Xaa in position 220 to 222 is any amino acid
  Variant (224)..(225): Xaa in position 224 to 225 is any amino acid
  Variant (230)..(232): Xaa in position 230 to 232 is any amino acid
  Variant (233)..(238): Xaa in position 233 to 238 is any or no amino acid
  Variant (241)..(258): Xaa in position 241 to 258 is any amino acid
  Variant (259)..(269): Xaa in position 259 to 269 is any or no amino acid
  Variant (271)..(271): Xaa in position 271 is any amino acid
  Variant (274)..(274): Xaa in position 274 is any amino acid
  Variant (275)..(278): Xaa in position 275 to 278 is any or no amino acid
  Variant (281)..(281): Xaa in position 281 is any amino acid
  Variant (283)..(286): Xaa in position 283 to 286 is any amino acid
  Variant (288)..(289): Xaa in position 288 to 289 is any amino acid
  Variant (291)..(296): Xaa in position 291 to 296 is any amino acid
  Variant (298)..(300): Xaa in position 298 to 300 is any amino acid
  Variant (302)..(304): Xaa in position 302 to 304 is any amino acid
  Variant (305)..(309): Xaa in position 305 to 309 is any or no amino acid
  Variant (311)..(311): Xaa in position 311 is any amino acid
  Variant (313)..(313): Xaa in position 313 is any amino acid
  Variant (316)..(319): Xaa in position 316 to 319 is any amino acid
  Variant (321)..(321): Xaa in position 321 is any amino acid
  Variant (323)..(323): Xaa in position 323 is any amino acid
  Variant (324)..(338): Xaa in position 324 to 338 is any or no amino acid
  Variant (341)..(341): Xaa in position 341 is any amino acid
  Variant (343)..(343): Xaa in position 343 is any amino acid
  Variant (346)..(346): Xaa in position 346 is any amino acid
  Variant (348)..(349): Xaa in position 348 to 349 is any amino acid
  Variant (351)..(352): Xaa in position 351 to 352 is any amino acid
  Variant (354)..(356): Xaa in position 354 to 356 is any amino acid
LXXPXXXXXXXPXXXXXXXXXXXXXRXXXXXIXXGXDXXXXRLXVXXGPCSXHDXXAAXXYAXXLXXXXXXXXXXXXLXXVMRXYFEKPRTXXXGWKGLINDPXXXXXXXXXXGLXXXRXLXXXXXXXXXXPXXXEXLDXXXPQYXXDXXXWXAIGARTTESQXHRXXASGLSXPXGFKNGTXGXXXXAXXAXXXAXXXHXFXXXXXXGXXXXXXTXGNXXXHXXLRGGXXXXXXXXXNYXXXXXXXXXXXXXXXXXXXXXXXXXXXXXDXSHXXXXXNSXKXXXXQXXVXXXXXXQXXXGXXXXXXXXGXMXESXXXXGXQXXXXXXXXXXXXXXXXYGXSXTDXCXXWXXTXXXL

SEQ ID NO: 1554 - protein, 41 aa, Artificial sequence
  protein pattern
  Variant (2)..(2): Xaa in position 2 is Phe or Tyr
  Variant (3)..(3): Xaa in position 3 is any amino acid
  Variant (4)..(4): Xaa in position 4 is Ala, Gly, Gln or Ser
  Variant (5)..(5): Xaa in position 5 is Asp or Glu
  Variant (6)..(7): Xaa in position 6 to 7 is any amino acid
  Variant (8)..(8): Xaa in position 8 is Ala, Cys, Gly, Ser or Thr
  Variant (9)..(9): Xaa in position 9 is any amino acid
  Variant (10)..(10): Xaa in position 10 is Ala, Gly, Ser or Thr
  Variant (11)..(11): Xaa in position 11 is Ala or Thr
  Variant (12)..(12): Xaa in position 12 is Ile, Met or Val
  Variant (21)..(21): Xaa in position 21 is any amino acid
  Variant (24)..(24): Xaa in position 24 is Glu or Gln
  Variant (25)..(25): Xaa in position 25 is Leu or Met
  Variant (26)..(26): Xaa in position 26 is Ala, Ser, Thr or Val
  Variant (28)..(28): Xaa in position 28 is Ala or Gly
  Variant (29)..(29): Xaa in position 29 is any amino acid
  Variant (31)..(31): Xaa in position 31 is any amino acid
  Variant (32)..(32): Xaa in position 32 is Ala, Pro or Ser
  Variant (33)..(33): Xaa in position 33 is Ile or Val
  Variant (35)..(35): Xaa in position 35 is Phe or Tyr
  Variant (38)..(40): Xaa in position 38 to 40 is any or no amino acid
QXXXXXXXXXXXGARTTESQXHRXXXSXXSXXXGXKNXXXG

SEQ ID NO: 1555 - protein, 21 aa, Artificial sequence
  protein pattern
  Variant (2)..(2): Xaa in position 2 is any amino acid
  Variant (3)..(3): Xaa in position 3 is any or no amino acid
  Variant (8)..(8): Xaa in position 8 is Ile or Val
  Variant (11)..(12): Xaa in position 11 to 12 is any amino acid
  Variant (13)..(13): Xaa in position 13 is Ala, Gln, Ser or Thr
  Variant (15)..(15): Xaa in position 15 is any amino acid
  Variant (16)..(16): Xaa in position 16 is Ala, Asp or Glu
  Variant (18)..(18): Xaa in position 18 is Ala, Gly or Ser
  Variant (19)..(20): Xaa in position 19 to 20 is any amino acid
  Variant (21)..(21): Xaa in position 21 is Phe, Ile, Leu or Met
VXXGPCSXHDXXXAXXYXXXX

SEQ ID NO: 1556 - protein, 21 aa, Artificial sequence
  protein pattern
  Variant (6)..(6): Xaa in position 6 is Ile or Val
  Variant (7)..(7): Xaa in position 7 is Asn, Ser or Thr
  Variant (10)..(10): Xaa in position 10 is any amino acid
  Variant (11)..(11): Xaa in position 11 is Ile, Leu, Met or Val
  Variant (12)..(12): Xaa in position 12 is Asp or Asn
  Variant (13)..(13): Xaa in position 13 is Asp, Glu, Gly, Asn, Gln or Ser
  Variant (14)..(19): Xaa in position 14 to 19 is any amino acid
  Variant (21)..(21): Xaa in position 21 is Ile, Leu, Met or Val
GWKGLXXDPXXXXXXXXXXGX

SEQ ID NO: 1557 - protein, 14 aa, Artificial sequence
  protein pattern
  Variant (2)..(2): Xaa in position 2 is any amino acid
  Variant (3)..(3): Xaa in position 3 is Ile, Leu or Val
  Variant (4)..(4): Xaa in position 4 is Ile or Val
  Variant (7)..(7): Xaa in position 7 is Ala, Thr or Val
  Variant (9)..(9): Xaa in position 9 is Phe or Leu
LXXXMRXYXEKPRT

SEQ ID NO: 1558 - protein, 14 aa, Artificial sequence
  protein pattern
  Variant (2)..(2): Xaa in position 2 is any amino acid
  Variant (4)..(4): Xaa in position 4 is Ile or Val
  Variant (7)..(7): Xaa in position 7 is Ala, Gly, Pro or Ser
  Variant (9)..(9): Xaa in position 9 is Ile, Leu or Val
  Variant (10)..(10): Xaa in position 10 is any amino acid
  Variant (12)..(13): Xaa in position 12 to 13 is any amino acid
  Variant (14)..(14): Xaa in position 14 is Ser or Thr
GXSXTDXCXXWXXX

SEQ ID NO: 1559 - protein, 14 aa, Artificial sequence
  protein pattern
  Variant (2)..(2): Xaa in position 2 is any amino acid
  Variant (5)..(5): Xaa in position 5 is Ala or Gly
  Variant (8)..(8): Xaa in position 8 is any amino acid
  Variant (10)..(13): Xaa in position 10 to 13 is any amino acid
DXSHXNSXKXXXXQ

SEQ ID NO: 1560 - protein, 13 aa, Artificial sequence
  protein pattern
  Variant (2)..(2): Xaa in position 2 is any amino acid
  Variant (5)..(6): Xaa in position 5 to 6 is any amino acid
  Variant (7)..(7): Xaa in position 7 is Ala, Cys, Gly, Ser, Thr or Val
  Variant (9)..(9): Xaa in position 9 is Ala, Ile, Leu or Val
  Variant (10)..(10): Xaa in position 10 is Ile or Val
TXGNXXXHXXLRG

SEQ ID NO: 1561 - protein, 19 aa, Artificial sequence
  protein pattern
  Variant (2)..(2): Xaa in position 2 is Asp, Glu, Asn or Ser
  Variant (3)..(4): Xaa in position 3 to 4 is any amino acid
  Variant (5)..(5): Xaa in position 5 is Ile, Leu or Val
  Variant (6)..(6): Xaa in position 6 is any amino acid
  Variant (8)..(8): Xaa in position 8 is any amino acid
  Variant (10)..(10): Xaa in position 10 is any amino acid
  Variant (13)..(13): Xaa in position 13 is any amino acid
  Variant (14)..(14): Xaa in position 14 is Ile or Leu
  Variant (15)..(16): Xaa in position 15 to 16 is any amino acid
  Variant (18)..(18): Xaa in position 18 is any amino acid
GXXXXXGXMXESXXXXGXQ

SEQ ID NO: 1562 - protein, 21 aa, Artificial sequence
  protein pattern
  Variant (2)..(2): Xaa in position 2 is Ala, Ile, Leu or Val
  Variant (3)..(3): Xaa in position 3 is Asp or Asn
  Variant (4)..(4): Xaa in position 4 is Ala or Gly
  Variant (5)..(6): Xaa in position 5 to 6 is any amino acid
  Variant (7)..(8): Xaa in position 7 to 8 is Ala, Ser, Thr or Val
  Variant (9)..(11): Xaa in position 9 to 11 is any amino acid
  Variant (13)..(13): Xaa in position 13 is any amino acid
  Variant (15)..(15): Xaa in position 15 is any amino acid
  Variant (16)..(16): Xaa in position 16 is Ala, Gly, Ser or Thr
  Variant (17)..(20): Xaa in position 17 to 20 is any amino acid
AXXXXXXXXXXHXFXXXXXXG

SEQ ID NO: 1563 - DNA, 246 bp, Escherichia coli
  CDS (1)..(246): transl_table=11
atgattaaagttctttttttcgcccaggtgcgcgagttggtgggaacagatgcaaccgaagtggctgcggatttcccaactgttgaagcgttacgccagcacatggctgcgcagagcgatcgctgggcgctggcgctggaagatggcaaattactggctgccgtcaaccagacgctggtgagttttgaccatccgctgactgacggcgacgaagtagctttcttcccgccggtaaccggaggttaa

SEQ ID NO: 1564 - protein, 81 aa, Escherichia coli
MIKVLFFAQVRELVGTDATEVAADFPTVEALRQHMAAQSDRWALALEDGKLLAAVNQTLVSFDHPLTDGDEVAFFPPVTGG

SEQ ID NO: 1565 - DNA, 258 bp, Burkholderia vietnamiensis G4
  CDS (1)..(258): transl_table=11
atgaagattcagctgaaattctttgcaagcgtgcgcgaggcactgggcgtgtccgacgagcaggccgacgtgcccgacggcgtgacgaccgtcggcgacgtgcgcgcgtggctgcgcctgcgcggcggcgcgtgggccgagacgctcgccgaagggcgtgcgttgcggatggcctgcaatcacgagatgaccgacccggaaacgcggctcaccgacgggtgtgaagtcgcgttttttccgccggtgaccggcggttga

SEQ ID NO: 1566 - protein, 85 aa, Burkholderia vietnamiensis G4
MKIQLKFFASVREALGVSDEQADVPDGVTTVGDVRAWLRLRGGAWAETLAEGRALRMACNHEMTDPETRLTDGCEVAFFPPVTGG

SEQ ID NO: 1567 - DNA, 330 bp, Oryza sativa (japonica cultivar-group)
  CDS (1)..(330)
atggcgctggatcccaaagccaatcacgctgccgctgctgctgcttccgccgacaaccccacggcggcggcggcgaaggcgaaggtgaaggtgaaggtgctcttcttcgcccgcgcgcgggacctgacgggcgtgacggaggccccggtggaggtgccggcagggagcacggcgggagactgcctcgcccgggtgctggccgccttccccaggctggaggagatccggcgatccatggtgctcgcgctcaacgaggagtacgcgcccgaggacgccgccgtcggggacggcgacgagctcgccatcatcccgcccatcagcggcggctga

SEQ ID NO: 1568 - protein, 109 aa, Oryza sativa (japonica cultivar-group)
MALDPKANHAAAAAASADNPTAAAAKAKVKVKVLFFARARDLTGVTEAPVEVPAGSTAGDCLARVLAAFPRLEEIRRSMVLALNEEYAPEDAAVGDGDELAIIPPISGG

SEQ ID NO: 1569 - DNA, 246 bp, Vibrio cholerae O1 biovar eltor str. N16961
  CDS (1)..(246): transl_table=11
atgattaaggtgctgttttttgcccaaactcgagagttggtggagtgcgatagtctggtggttgaccacgcttttgcaacggtagaagctttgcgccaacatttagcgcagcagccgggtaagtgggatatggcacttgaaccgggtaagctattggcggccgttaatcaatcgattgtgccattcgatacagagctacaagatggcgatgaagtggcctttttcccaccagtgactggaggctag

SEQ ID NO: 1570 - protein, 81 aa, Vibrio cholerae O1 biovar eltor str. N16961
MIKVLFFAQTRELVECDSLVVDHAFATVEALRQHLAQQPGKWDMALEPGKLLAAVNQSIVPFDTELQDGDEVAFFPPVTGG

SEQ ID NO: 1571 - DNA, 246 bp, Pasteurella multocida subsp. multocida str. Pm70
  CDS (1)..(246): transl_table=11
atgctaaacattttattttttgctcaaaccagagaacttatcggcgtcgatagccttgaattacctgccacgtttaagacagcagagcaagttcgtcagcatttagctgaaaaaggcgagcgttgggcgttagcacttgaaaaaggcaaattattagtggcaattaatcaggctttagtgcctttagatacagaagtgaaagcgggtgatgaagtcgcgtttttcccacccgtgactggaggataa

SEQ ID NO: 1572 - protein, 81 aa, Pasteurella multocida subsp. multocida str. Pm70
MLNILFFAQTRELIGVDSLELPATFKTAEQVRQHLAEKGERWALALEKGKLLVAINQALVPLDTEVKAGDEVAFFPPVTGG

SEQ ID NO: 1573 - DNA, 252 bp, Pseudomonas aeruginosa PAO1
  CDS (1)..(252): transl_table=11
atgatccgcgtgcagtatttcgcccgttaccgcgaagccctcggcatcgacggcgagcagttgaactgggacgccgggctggcgaccctcggcgccttgcgccagctcctggtggagcgcggcggggcctgggagcgtaccctcggcgagcagaacctgatgtgcgcgcgcaatcaggaactgtgcggcctcgacgagccgttgcaggacggcgacgaagtcgccttcttccccaccgtcaccggaggttga

SEQ ID NO: 1574 - protein, 83 aa, Pseudomonas aeruginosa PAO1
MIRVQYFARYREALGIDGEQLNWDAGLATLGALRQLLVERGGAWERTLGEQNLMCARNQELCGLDEPLQDGDEVAFFPTVTGG

SEQ ID NO: 1575 - DNA, 258 bp, Agrobacterium tumefaciens str. C58
  CDS (1)..(258): transl_table=11
atgatgacgcggatcgtttatttcgcctgggttcgcgagaagatcggcacggatgaggaagagctggatatcccttcctccgtcaccaccgccggcgagctgatcgcctatcttgcgacacgcggtgaaaattacgaagcggccttcgagtttcccaatgtcatcagggttgccgtcaatcaggaacatgtcgagcatgacgagagcattgtcggcgcacgcgagatcggcatcttcccgcccatgacgggaggatga

SEQ ID NO: 1576 - protein, 85 aa, Agrobacterium tumefaciens str. C58
MMTRIVYFAWVREKIGTDEEELDIPSSVTTAGELIAYLATRGENYEAAFEFPNVIRVAVNQEHVEHDESIVGAREIGIFPPMTGG

SEQ ID NO: 1577 - DNA, 252 bp, Salmonella enterica subsp. enterica serovar Typhi str. CT18
  CDS (1)..(252): transl_table=11
atgcgcatgattaaagtgcttttcttcgcccacgttcgcgagcttacaggaactgatgcgctggatcttccagcagatttttccaccgttgagtcgctgcgacagcatctggcgacaaagagcgatcgttgggcgctggcgctggaagacggcaagctgttggcggcggtcaaccagacgctggtaagttttgaccatccgctgacggcgggcgatgaagtggcgtttttcccgccagtcacggggggctaa

SEQ ID NO: 1578 - protein, 83 aa, Salmonella enterica subsp. enterica serovar Typhi str. CT18
MRMIKVLFFAHVRELTGTDALDLPADFSTVESLRQHLATKSDRWALALEDGKLLAAVNQTLVSFDHPLTAGDEVAFFPPVTGG

SEQ ID NO: 1579 - DNA, 252 bp, Salmonella typhimurium LT2
  CDS (1)..(252): transl_table=11
atgcgcatgattaaagtgcttttcttcgcccaggttcgcgagcttacaggaactgacgcgctggatcttccagcagatttttccaccgttgagtcgctgcgacagcatctggcgacaaagagcgatcgttgggcgctggcgctggaagatggcaagctgttggcggcggtcaaccagacgctggtaagttttgaccatccgctgacggcgggcgatgaagtggcgtttttcccgccagtcacggggggctaa

SEQ ID NO: 1580 - protein, 83 aa, Salmonella typhimurium LT2
MRMIKVLFFAQVRELTGTDALDLPADFSTVESLRQHLATKSDRWALALEDGKLLAAVNQTLVSFDHPLTAGDEVAFFPPVTGG

SEQ ID NO: 1581 - DNA, 264 bp, Ralstonia solanacearum GMI1000
  CDS (1)..(264): transl_table=11
atggacatgcagatcgaattgcgttttttcgccagcgtgcgcgagcaactgggcacctcgcacgaggcggccgccgtgccggacacggtgcgcaccgtcggcgagctgcgccgctggctggccgcgcgtgggccggcgtggggcgagaccctggccgagggccgcgcgctgcgcatggcgctggaccacgatgtggtcaccgccgatgcgccgctgcgcgagggctgcgaggtcgcgttctttccgccggtgacgggcggctga

SEQ ID NO: 1582 - protein, 87 aa, Ralstonia solanacearum GMI1000
MDMQIELRFFASVREQLGTSHEAAAVPDTVRTVGELRRWLAARGPAWGETLAEGRALRMALDHDVVTADAPLREGCEVAFFPPVTGG

SEQ ID NO: 1583 - DNA, 255 bp, Agrobacterium tumefaciens str. C58
  CDS (1)..(255): transl_table=11
atgacgcggatcgtttatttcgcctgggttcgcgagaagatcggcacggatgaggaagagctggatatcccttcctccgtcaccaccgccggcgagctgatcgcctatcttgcgacacgcggtgaaaattacgaagcggccttcgagtttcccaatgtcatcagggttgccgtcaatcaggaacatgtcgagcatgacgagagcattgtcggcgcacgcgagatcggcatcttcccgcccatgacgggaggatga

SEQ ID NO: 1584 - protein, 84 aa, Agrobacterium tumefaciens str. C58
MTRIVYFAWVREKIGTDEEELDIPSSVTTAGELIAYLATRGENYEAAFEFPNVIRVAVNQEHVEHDESIVGAREIGIFPPMTGG

SEQ ID NO: 1585 - DNA, 252 bp, Shewanella oneidensis MR-1
  CDS (1)..(252): transl_table=11
atgattaatgtgttgttttttgcgcaggttcgtgagcttttagggactgcccaactgagtattgaagcgagcgaacagacacaaactgcagaaggattacgcgcgacactcgcggccaccgatgataaatgggccaaagtgttagcctctgacaaattgctggtggcagtgaatcaaaccattagccagtgggatacccgagtgaacgatggtgatgaagtggccttcttcccacctgtgacaggaggttga

SEQ ID NO: 1586 - protein, 83 aa, Shewanella oneidensis MR-1
MINVLFFAQVRELLGTAQLSIEASEQTQTAEGLRATLAATDDKWAKVLASDKLLVAVNQTISQWDTRVNDGDEVAFFPPVTGG

SEQ ID NO: 1587 - DNA, 249 bp, Pseudomonas putida KT2440
  CDS (1)..(249): transl_table=11
gtgatgaaggtcaaagtgatgtacttcgcccgttaccgcgaactgttgggcgtggatgccgagcgggtggagggggcgttcaaggtgctcgatgatgtgcgccaggccttggttgccaagggcgggcagtatgaagtgctggccgagcagaacctgatgtgcgcgcgcaacgaagagctgtgcaagctcgatgaaccgctggaagagggcgatgaagtggcgttcttcccaccggtgaccggaggctga

SEQ ID NO: 1588 - protein, 82 aa, Pseudomonas putida KT2440
MMKVKVMYFARYRELLGVDAERVEGAFKVLDDVRQALVAKGGQYEVLAEQNLMCARNEELCKLDEPLEEGDEVAFFPPVTGG

SEQ ID NO: 1589 - DNA, 246 bp, Vibrio vulnificus CMCP6
  CDS (1)..(246): transl_table=11
atgattaaggttttattctttgctcaaacccgtgagctggtgggtgtggattcagtcgatgtagaggcgaacttcgacaccgttgaatcacttcgagcacatttagcagagcaagaaggtaagtggtcacttgctttagaggctgggaaattgcttgctgcagtcaatcagtcgattgttccactggaaacaacactgcaagatggtgacgaagtggcctttttccctcccgtgacaggggggtag

SEQ ID NO: 1590 - protein, 81 aa, Vibrio vulnificus CMCP6
MIKVLFFAQTRELVGVDSVDVEANFDTVESLRAHLAEQEGKWSLALEAGKLLAAVNQSIVPLETTLQDGDEVAFFPPVTGG

SEQ ID NO: 1591 - DNA, 252 bp, Bradyrhizobium japonicum USDA 110
  CDS (1)..(252): transl_table=11
atgaaggtgaaatattttgcctgggtgcgcgaacgcgtcggcaaggccgaggaaaccatcgagccgcccgcgaccgtgcgcaccgtcgaggagctgatcgcctggctgtccggccggagcgaggcctatgcctatgcgttcgagaagccgaaggtcatccgcgccgcgatcgaccatgcccatgtcaagtcggacgccgcaatcgcgggcgcccgcgagatcgcgttcttcccgccgatgaccggcggctag

SEQ ID NO: 1592 - protein, 83 aa, Bradyrhizobium japonicum USDA 110
MKVKYFAWVRERVGKAEETIEPPATVRTVEELIAWLSGRSEAYAYAFEKPKVIRAAIDHAHVKSDAAIAGAREIAFFPPMTGG

SEQ ID NO: 1593 - DNA, 246 bp, Pseudomonas syringae pv. tomato str. DC3000
  CDS (1)..(246): transl_table=11
atgaagattgaggtccagtactttgcccgttatcgcgaaacgttgggcatagacagcgagtctgtcgaaggcgagttcgtcacgctggaggtgttgcgtcagcatctgttgcaacgtggcgaagcgtggcaggttctggccgaacagaacctgatgtgtgcgcgcaatcaggagctctgtaagcttgacgaacccctgcttgatggcgacgaagtcgcgttctttccgcctgtgaccggaggctga

SEQ ID NO: 1594 - protein, 81 aa, Pseudomonas syringae pv. tomato str. DC3000
MKIEVQYFARYRETLGIDSESVEGEFVTLEVLRQHLLQRGEAWQVLAEQNLMCARNQELCKLDEPLLDGDEVAFFPPVTGG

SEQ ID NO: 1595 - DNA, 258 bp, Vibrio parahaemolyticus RIMD 2210633
  CDS (1)..(258): transl_table=11
atgattaaagtacttttctttgctcaaacccgcgagctagtgggtatcgacagcgttgatttggacggccagttcgatacggtcgaagccgttcgcgcacatcttgtcgaagcgggcgcagaaaaagcaggcaagtgggatttggcgcttgagccaggcaagctgcttgctgcagtgaaccaatcgatcgtcccactggatacacaagtaaaagcgggtgacgaagtcgcgtttttcccaccggtaacgggaggctaa

SEQ ID NO: 1596 - protein, 85 aa, Vibrio parahaemolyticus RIMD 2210633
MIKVLFFAQTRELVGIDSVDLDGQFDTVEAVRAHLVEAGAEKAGKWDLALEPGKLLAAVNQSIVPLDTQVKAGDEVAFFPPVTGG

SEQ ID NO: 1597 - DNA, 246 bp, Shigella flexneri 2a str. 2457T
  CDS (1)..(246): transl_table=11
atgattaaagttctttttttcgcccaggtgcgcgagttggtgggaacagatgcaaccgaagtggctgcggattacccaaccgttgaagcgttacgccagcacctggctgcgcagagcgatcgctgggcgctggcgctggaagatggcaaattgctggctgccgtcaaccagacgctggtgagttttgaccatccgctgactgacggcgacgaagtagctttcttcccgccggtaaccggaggttaa

SEQ ID NO: 1598 - protein, 81 aa, Shigella flexneri 2a str. 2457T
MIKVLFFAQVRELVGTDATEVAADYPTVEALRQHLAAQSDRWALALEDGKLLAAVNQTLVSFDHPLTDGDEVAFFPPVTGG

SEQ ID NO: 1599 - DNA, 246 bp, Haemophilus ducreyi 35000HP
  CDS (1)..(246): transl_table=11
atgattacagttttattttttgctcaagtgagagaattagtcaataccgaaaaattacaactagcggctgaatttgccactgctgaacaattgcgtgtacatttaagccaacaagggaaaaaatggcaattagcattagaaaaagacaagttattagtggcgattaatcaaaaaattttaccgcttgatagccagattaacgcaggtgatgaaattgccttttttccgccggtaactggaggttag

SEQ ID NO: 1600 - protein, 81 aa, Haemophilus ducreyi 35000HP
MITVLFFAQVRELVNTEKLQLAAEFATAEQLRVHLSQQGKKWQLALEKDKLLVAINQKILPLDSQINAGDEIAFFPPVTGG

SEQ ID NO: 1601 - DNA, 252 bp, Bordetella pertussis Tohama I
  CDS (1)..(252): transl_table=11
gtgagtggcgcaacgattaaggttctgtatttcgcgcgcgtggccgaactcgtcggcaagcgcaccgaagactggccgctggccgaaaccgtgaccggcgcgcagctgctggccgcgctggcggcacgctatccgcagctggagccggccgagcgcctgaagctggccgtcaaccagacgcatgtcaaggtgggcgcgtcggtgcgcccgggcgacgaggtcgcggtcttcgaaccggtgaccgggggttga

SEQ ID NO: 1602 - protein, 83 aa, Bordetella pertussis Tohama I
MSGATIKVLYFARVAELVGKRTEDWPLAETVTGAQLLAALAARYPQLEPAERLKLAVNQTHVKVGASVRPGDEVAVFEPVTGG

SEQ ID NO: 1603 - DNA, 252 bp, Bordetella parapertussis 12822
  CDS (1)..(252): transl_table=11
gtgagtggcgcaacgattaaggttctgtatttcgcgcgcgtggccgaactcgtcggcaagcgcaccgaagactggccgctggccgaaaccgtgaccggcgcgcagctgctggccgcgctagcggcacgctatccgcagctggagccggccgagcgcctgaagctggccgtcaaccagacgcatgtcaaggtgggcgcggcggtgcgcccgggcgacgaggtcgcgatcttcgaaccggtgaccgggggttga

SEQ ID NO: 1604 - protein, 83 aa, Bordetella parapertussis 12822
MSGATIKVLYFARVAELVGKRTEDWPLAETVTGAQLLAALAARYPQLEPAERLKLAVNQTHVKVGAAVRPGDEVAIFEPVTGG

SEQ ID NO: 1605 - DNA, 252 bp, Bordetella bronchiseptica RB50
  CDS (1)..(252): transl_table=11
gtgagtggcgcaacgattaaggttctgtatttcgcgcgcgtggccgaactcgtcggcaagcgcaccgaagactggccgctggccgaaaccgtgaccggcgcgcagctgctggccgcgctggcggcacgctatccgcagctggagccggccgagcgcctgaagctggccgtcaaccagacgcatgtcaaggtgggcgcggcggtgcgcccgggcgacgaggtcgcggtcttcgaaccggtgaccgggggttga

SEQ ID NO: 1606 - protein, 83 aa, Bordetella bronchiseptica RB50
MSGATIKVLYFARVAELVGKRTEDWPLAETVTGAQLLAALAARYPQLEPAERLKLAVNQTHVKVGAAVRPGDEVAVFEPVTGG

SEQ ID NO: 1607 - DNA, 252 bp, Chromobacterium violaceum ATCC 12472
  CDS (1)..(252): transl_table=11
atgaaattgagcctgctgtatttcgccaggctgcgcgagacgctgggcgtggagagcgagcaattggacagcgaggcggccaacgtggccgagctgctggccgaattgcgccagcgcggccaggtctggacgctggagctggcggcggacaaggtgttccgggtggcggtgaaccaggaaatggcgggactggacacgcccttggccgacggcgacgaagtggcggtgtttccgccggtgaccgggggctga

SEQ ID NO: 1608 - protein, 83 aa, Chromobacterium violaceum ATCC 12472
MKLSLLYFARLRETLGVESEQLDSEAANVAELLAELRQRGQVWTLELAADKVFRVAVNQEMAGLDTPLADGDEVAVFPPVTGG

SEQ ID NO: 1609 - DNA, 246 bp, Photorhabdus luminescens subsp. laumondii TTO1
  CDS (1)..(246): transl_table=11
atgattaaagtcctgttttttgctcaggtacgtgagctggtaggtactgattcactggatctcgataatcgttacacaaccgttgacagtttgagaatggcgttaatatcaaagggagaacgttgggctttggcattggaaaatggaaaattgttgtcagcggtaaaccaatctctggttcatggcgggcaccgattacaggatggcgatgaagtggcctttttcccgccggtgactgggggataa

SEQ ID NO: 1610 - protein, 81 aa, Photorhabdus luminescens subsp. laumondii TTO1
MIKVLFFAQVRELVGTDSLDLDNRYTTVDSLRMALISKGERWALALENGKLLSAVNQSLVHGGHRLQDGDEVAFFPPVTGG

SEQ ID NO: 1611 - DNA, 252 bp, Rhodopseudomonas palustris CGA009
  CDS (1)..(252): transl_table=11
atgaaggtgaagtatttcgcctgggtgcgcgagcggatcggcgtcgacgaagagacggtcgaaccgccgccggcggtgacaaccgtcgccgacctgattggctggctggcggcgcgcggcgaaggctacgcgctggcgttcgaaaagccggacgtgatccgcgccgcgatcgatcgcgcccatgtccgcgccgagacgccgattcatggcgcacgcgaggtcgcattcttcccgccgatgaccggcggttga

SEQ ID NO: 1612 - protein, 83 aa, Rhodopseudomonas palustris CGA009
MKVKYFAWVRERIGVDEETVEPPPAVTTVADLIGWLAARGEGYALAFEKPDVIRAAIDRAHVRAETPIHGAREVAFFPPMTGG

SEQ ID NO: 1613 - DNA, 246 bp, Erwinia carotovora subsp. atroseptica SCRI1043
  CDS (1)..(246): transl_table=11
atgattaagattctgttttttgcgcaggtgcgtgaattgatcgaaacagacagcctgtcgctgcccgctgattatgccaccgtagaggaggttcgacaggcgttgtgccaacgtggtgctcgttgggaattagcattggaagccggcaaattgttggcagcagtaaatcagtcgctggttgagttgacgcacccgctacaggacggtgatgaagtcgcctttttcccaccggtaacgggaggttga

SEQ ID NO: 1614 - protein, 81 aa, Erwinia carotovora subsp. atroseptica SCRI1043
MIKILFFAQVRELIETDSLSLPADYATVEEVRQALCQRGARWELALEAGKLLAAVNQSLVELTHPLQDGDEVAFFPPVTGG

SEQ ID NO: 1615 - DNA, 246 bp, Mannheimia succiniciproducens MBEL55E
  CDS (1)..(246): transl_table=11
atgctgaaagtattatttttcgcacaaacgagagagttggtgggtgtcgatcaaattgatgtcgaagcggcattttcaacggctgaagcattacgtgcgcatttagcggaaaaaggcggaaaatgggcattggctctagaagcgggcaaattattggttgctattaatcaaactttatcatcgctggacagctcgattcgggacggcgatgaaattgccttttttccgcctgttaccgggggataa

SEQ ID NO: 1616 - protein, 81 aa, Mannheimia succiniciproducens MBEL55E
MLKVLFFAQTRELVGVDQIDVEAAFSTAEALRAHLAEKGGKWALALEAGKLLVAINQTLSSLDSSIRDGDEIAFFPPVTGG

SEQ ID NO: 1617 - DNA, 258 bp, Burkholderia mallei ATCC 23344
  CDS (1)..(258): transl_table=11
atgaagattgaactgaagtttttcgcgagcgtgcgcgaagcgctcggcgtggcgagcgagacggtgacggtgccggacggtgtcgcgacggtgggcgacgtgcgcgcatggctgcgcgcgcgcggcggcgcgtgggcggacacgctcgccgagggccgcgcgttgcggatggcgtgcaaccacacgatgacggacgccggcacgcggatcaccgaaggctgcgaggtcgcgttcttcccgcccgtgacgggcggctga

SEQ ID NO: 1618 - protein, 85 aa, Burkholderia mallei ATCC 23344
MKIELKFFASVREALGVASETVTVPDGVATVGDVRAWLRARGGAWADTLAEGRALRMACNHTMTDAGTRITEGCEVAFFPPVTGG

SEQ ID NO: 1619 - DNA, 255 bp, Azoarcus sp. EbN1
  CDS (1)..(255): transl_table=11
atgaacatcaaaatcctttatttcgcggcgctcagggacgccgtcgggcgtgccgaagaatcgttcgtgctgccctccggggtcgccacggtcggcgatctgcgcgctttccttgccgaccggggcgacaagtgggacgcgctcgcagaggggcgcaacgtgcgtgcggcccgcaatcagcgcatggcgggcccgactgatccggtcgggcccggcgacgagatcgcattctttccgccggtcaccggaggctga

SEQ ID NO: 1620 - protein, 84 aa, Azoarcus sp. EbN1
MNIKILYFAALRDAVGRAEESFVLPSGVATVGDLRAFLADRGDKWDALAEGRNVRAARNQRMAGPTDPVGPGDEIAFFPPVTGG

SEQ ID NO: 1621 - DNA, 240 bp, Bacillus clausii KSM-K16
  CDS (1)..(240): transl_table=11
atgattaaagttcttttttttgccgggctagccgaacaagctggccaggcagaaacagaagttgattttgctggaaggacagtagaagaattgacagagtgggccattgacacgcataggctttctcctgattcgctgaatggcgccatggttgcagtaaacgaagagtttgcgagccaatcgacagagctgacagcaggggatgtcgtggcttttattccacctgtaagcggcggttaa

SEQ ID NO: 1622 - protein, 79 aa, Bacillus clausii KSM-K16
MIKVLFFAGLAEQAGQAETEVDFAGRTVEELTEWAIDTHRLSPDSLNGAMVAVNEEFASQSTELTAGDVVAFIPPVSGG

SEQ ID NO: 1623 - DNA, 246 bp, Pseudomonas syringae pv. syringae B728a
  CDS (1)..(246): transl_table=11
atgaaggttcaggttcagtattttgcccgttaccgtgaagtcctgggcctggacagcgagtccgttgaaggcgagttcgccacgctggacgcattgcgccagacgctgctgcagcgcggcgaggtctggcaagtgcttgccgaacagaacctgatgtgtgctcgcaaccaggagctgtgcaagccgaccgaaccattggccgatggcgatgaagtcgcgttctttccgcccgtgaccggaggttga

SEQ ID NO: 1624 - protein, 81 aa, Pseudomonas syringae pv. syringae B728a
MKVQVQYFARYREVLGLDSESVEGEFATLDALRQTLLQRGEVWQVLAEQNLMCARNQELCKPTEPLADGDEVAFFPPVTGG

SEQ ID NO: 1625 - DNA, 246 bp, Haemophilus influenzae 86-028NP
  CDS (1)..(246): transl_table=11
atgttaaatattttattttttgctcaaactcgtgaattaattggcgttgatgccattcaattagaagatgattttgccactgcggaagcggtgcgtgaacaccttgctcaaaaaggcgataagtgggcattggcactggaaaaaggtaaacttttagtggcaattaatcaaaccttaatgcctttagaaagtgcggtaaaaaatggcgatgaaattgcctttttcccaccagtaacagggggctaa

SEQ ID NO: 1626 - protein, 81 aa, Haemophilus influenzae 86-028NP
MLNILFFAQTRELIGVDAIQLEDDFATAEAVREHLAQKGDKWALALEKGKLLVAINQTLMPLESAVKNGDEIAFFPPVTGG

SEQ ID NO: 1627 - DNA, 243 bp, Pseudomonas fluorescens Pf-5
  CDS (1)..(243): transl_table=11
atgaagatctcggtgaaatttttcgctcgctaccgcgaggccctgggcattgacgggctggagatcgaaggcgtgttccagcaggtcgaggatgtgcgccaggcgttgctgtcccgggacggggccgaggtattggccgagcagaacctgatgtgcgcccgcaatgaagagctgtgccagctggacgaacccctggaagacggcgacgaagtggcgtttttccccacggtgaccggaggttga

SEQ ID NO: 1628 - protein, 80 aa, Pseudomonas fluorescens Pf-5
MKISVKFFARYREALGIDGLEIEGVFQQVEDVRQALLSRDGAEVLAEQNLMCARNEELCQLDEPLEDGDEVAFFPTVTGG

SEQ ID NO: 1629 - DNA, 252 bp, Pseudomonas fluorescens Pf-5
  CDS (1)..(252): transl_table=11
atgattctggtcaactactttgcccgctaccgtgagcaactgggttgcggtggcgagaaactgcccctggatgccagcctgcgcaccgtcgaggacctgcgccagcggctgatggcccggggtgaaacctgggcgcaggtgctgggggagaacagcctgatgtgcgcgctgaaccaggaactgtgcaagctcgatgcggccatcgaggacttcgatgaaatcgccttctttccgcaagtgaccggaggctga

SEQ ID NO: 1630 - protein, 83 aa, Pseudomonas fluorescens Pf-5
MILVNYFARYREQLGCGGEKLPLDASLRTVEDLRQRLMARGETWAQVLGENSLMCALNQELCKLDAAIEDFDEIAFFPQVTGG

SEQ ID NO: 1631 - DNA, 249 bp, Colwellia psychrerythraea 34H
  CDS (1)..(249): transl_table=11
atgataaaaattgttttttttgcagcacttagagagcaacttgactgtgctgaactgtctctagcagcagatgatgctaagacagtcgatgatattaagcagttattaagtgataaaaatgaacagtggcaacaaacgttcagtaatacgtcactgttatctgcggtaaaccatgacatggttgatggtagtcacttggtaaaatcaggcgatgaagttgcctttttccctccagttaccggcggataa

SEQ ID NO: 1632 - protein, 82 aa, Colwellia psychrerythraea 34H
MIKIVFFAALREQLDCAELSLAADDAKTVDDIKQLLSDKNEQWQQTFSNTSLLSAVNHDMVDGSHLVKSGDEVAFFPPVTGG

SEQ ID NO: 1633 - DNA, 246 bp, Pseudomonas syringae pv. phaseolicola 1448A
  CDS (1)..(246): transl_table=11
atgaaggtacaggttcagtattttgcccgttaccgtgaagtccttggcctggacagcgagtctgtcgaaggcacgttcgacacgctggacgcactgcgccaaacgctgttgcagcgtggcgaggcctggcaggtccttgccgagcagaacctgatgtgtgcccgcaaccaggaactgtgcaagccgaccgagccgctgtctgatggcgatgaagtcgcgttctttccgcccgtgaccggaggctga

SEQ ID NO: 1634 - protein, 81 aa, Pseudomonas syringae pv. phaseolicola 1448A
MKVQVQYFARYREVLGLDSESVEGTFDTLDALRQTLLQRGEAWQVLAEQNLMCARNQELCKPTEPLSDGDEVAFFPPVTGG

SEQ ID NO: 1635 - DNA, 249 bp, Dechloromonas aromatica RCB
  CDS (1)..(249): transl_table=11
gtgagcgtcaaggttctctacttcgccggcctcaaggaggccctcggcctgcccggcgaaaccatcgacctgccagtcggtgtcgccaccgtcggcggcttgcgtgattggctggtcgggcaagggcgcgacaagctggccaccgccaaaaacctgcgctgcgccgtcaatcaagacatggccaagctcgatgcagccatcaaggacggcgacgagatagccttcttcccgccggtcaccggcggttga

SEQ ID NO: 1636 - protein, 82 aa, Dechloromonas aromatica RCB
MSVKVLYFAGLKEALGLPGETIDLPVGVATVGGLRDWLVGQGRDKLATAKNLRCAVNQDMAKLDAAIKDGDEIAFFPPVTGG

SEQ ID NO: 1637 - DNA, 258 bp, Ralstonia eutropha JMP134
  CDS (1)..(258): transl_table=11
atgaacatcgaactacgtttctttgccagcgtgcgcgaacaactgggcgttgccggggagcgcgccgaagtcccgggcgacgtgcgcacggtaggcgagcttcgccaatggctgcgtgcgcgcggtggcgcgtgggcggaagcgctggcggaaggccgtgcgctgcgcatggccgttgaccacgccgtggcacgcgctgatacggcgatcaccgaaggctgcgaggtggccttcttcccaccggtcaccggaggctga

SEQ ID NO: 1638 - protein, 85 aa, Ralstonia eutropha JMP134
MNIELRFFASVREQLGVAGERAEVPGDVRTVGELRQWLRARGGAWAEALAEGRALRMAVDHAVARADTAITEGCEVAFFPPVTGG

SEQ ID NO: 1639 - DNA, 243 bp, Pseudomonas fluorescens PfO-1
  CDS (1)..(243): transl_table=11
atgaacctgaccgtgaagttttttgcccgttaccgcgaagcgctgggcgtggattcggtgacggtcgagggtgatttcgccaccgtcgatgatgttcgtgcgttgctggcgcagcgtgagggcgccgaggtgctgagcgaacagaacctgatgtgcgcacgcaacgaagacctctgccagctcgacgagccggtggtggacggcgacgaagtggcgttttttcccaccgtgaccggaggctga

SEQ ID NO: 1640 - protein, 80 aa, Pseudomonas fluorescens PfO-1
MNLTVKFFARYREALGVDSVTVEGDFATVDDVRALLAQREGAEVLSEQNLMCARNEDLCQLDEPVVDGDEVAFFPTVTGG

SEQ ID NO: 1641 - DNA, 252 bp, Pseudomonas fluorescens PfO-1
  CDS (1)..(252): transl_table=11
atgattctgatcaactacttcgccagctaccgtgaccggctcaatctgggcggtgaaaagattccggccagcgacaccctcgcttgtgtcgaagatgtgcggcaaatgctgatgcagcgcggcgatgtctggcgtgaagtgctcggtgccggcaacctgatgtgcgcggtgaatcaggagctgtgtcagccggatcaggccattgaggacttcgacgagattgcgtttttcccgccggtcacggggggttga

SEQ ID NO: 1642 - protein, 83 aa, Pseudomonas fluorescens PfO-1
MILINYFASYRDRLNLGGEKIPASDTLACVEDVRQMLMQRGDVWREVLGAGNLMCAVNQELCQPDQAIEDFDEIAFFPPVTGG

SEQ ID NO: 1643 - DNA, 249 bp, Rhodobacter sphaeroides 2.4.1
  CDS (1)..(249): transl_table=11
atgatcgatctgctttatttcgcctgggtccgcgagcggatcgggctgccgcgcgagcggctggagaccgaggccgccaccgtggcggagctggtcgaggagctccgcgcgcgcgaggagcgctatgatctggcctttgccgatctctcgagcctcagggtcgctctcgatcaggagctggccgagttcgacgcgccgctcgagggcgtgcgcgaggtggccttcttcccgccgatgaccgggggctga

SEQ ID NO: 1644 - protein, 82 aa, Rhodobacter sphaeroides 2.4.1
MIDLLYFAWVRERIGLPRERLETEAATVAELVEELRAREERYDLAFADLSSLRVALDQELAEFDAPLEGVREVAFFPPMTGG

SEQ ID NO: 1645 - DNA, 258 bp, Burkholderia sp. 383
  CDS (1)..(258): transl_table=11
atgaaactgacgatcaaatactttgcaagcattcgcgagcaactcgatctcgacgaggaaatcgtcgagatcgacgcgcgcgagctcaccgtcgacgcgctgcgcgacacgctggccgcacgcgatgcacgcagcgcggaagcgctgcggacggaccggcccgtgcgcgcggccgtcaatctcgagatggtgacggggggattcgtcgtgcgggaggacagcgaggtggcgtttttcccgccggtgacgggcggctga

SEQ ID NO: 1646 - protein, 85 aa, Burkholderia sp. 383
MKLTIKYFASIREQLDLDEEIVEIDARELTVDALRDTLAARDARSAEALRTDRPVRAAVNLEMVTGGFVVREDSEVAFFPPVTGG

SEQ ID NO: 1647 - DNA, 258 bp, Burkholderia sp. 383
  CDS (1)..(258): transl_table=11
atgaagattcaactgaaattttttgcaagcgtacgcgaggcactgggtgtcgccgacgagcaggccgacgtgccggacagcgtcacgaccgtgggcgacgtgcgcgcgtggctgcgcgtgcgcggcggtgcatgggccgagacgctcgccgaagggcgtgcactgcgcatggcgtgcaatcacgagatgaccgatcccgacacgcggctcaccgaaggctgcgaggtcgctttctttccgccggtgacgggcggttga

SEQ ID NO: 1648 - protein, 85 aa, Burkholderia sp. 383
MKIQLKFFASVREALGVADEQADVPDSVTTVGDVRAWLRVRGGAWAETLAEGRALRMACNHEMTDPDTRLTEGCEVAFFPPVTGG

SEQ ID NO: 1649 - DNA, 252 bp, Rhodospirillum rubrum ATCC 11170
  CDS (1)..(252): transl_table=11
atgaaactgctctatttcgcctgggtgcgcgagaccgtcggcctggacgaggaaaccctatccctgccgcccggcgtcaccaccttgggcgacctcgccctgtggcaggccgggcgcggcgccggctatgcggaagcgttttccgacccccgccgcctgcgcgccgcggtcaatcaagacctcgccacccccgagacgcctttgaccgccagcgatgaagtggcgttcttcccgccgctgaccgggggctga

SEQ ID NO: 1650 - protein, 83 aa, Rhodospirillum rubrum ATCC 11170
MKLLYFAWVRETVGLDEETLSLPPGVTTLGDLALWQAGRGAGYAEAFSDPRRLRAAVNQDLATPETPLTASDEVAFFPPLTGG

SEQ ID NO: 1651 - DNA, 264 bp, Burkholderia thailandensis E264
  CDS (1)..(264): transl_table=11
atgacgatgaagatcgaactgaagttttttgcgagcgtgcgcgaagcgctcggcgtcgcgagcgagacggtgacggtgccggacggcgtcgcgacggtgggcgacgtgcgcgcgtggctgcgcgcgcgcggcggcgcatgggcggacacgctcgccgagggccgtgcgctgcgcatggcgtgcaaccatacgatgacggacgccggcacgcggatcaccgacggctgcgaggtcgcgttcttcccgccggtgacgggcggctga

SEQ ID NO: 1652 - protein, 87 aa, Burkholderia thailandensis E264
MTMKIELKFFASVREALGVASETVTVPDGVATVGDVRAWLRARGGAWADTLAEGRALRMACNHTMTDAGTRITDGCEVAFFPPVTGG

SEQ ID NO: 1653 - DNA, 267 bp, Saccharophagus degradans 2-40
  CDS (1)..(267): transl_table=11
atgacggcctcagaaaaaacactgtctattctctactttgccagcctaggcgaaacactgcgcaccaacagcgaaacactggcggtagataactcggtaattagcgtaagcgacttaattgcactgcttgcgcagcgcggtgaaaattggcaactgctacaagacaaaaccaccaaatgtgccgttaaccaaaccattgcgagtaaagaccagcctttaagccataacgatgaagtagcgtttttccctccggtaacaggcggctaa

SEQ ID NO: 1654 - protein, 88 aa, Saccharophagus degradans 2-40
MTASEKTLSILYFASLGETLRTNSETLAVDNSVISVSDLIALLAQRGENWQLLQDKTTKCAVNQTIASKDQPLSHNDEVAFFPPVTGG

SEQ ID NO: 1655 - DNA, 252 bp, Methylobacillus flagellatus KT
  CDS (1)..(252): transl_table=11
atgattcagctactgtacttcgccaggctgcgtgaagcgcttgggaccgaaagcgaaagcctgcactggccggaaccagcgacggtttctgcattgatgcagtcgctggctacgcgcggtggagtatgggaagagcagttttctggcaatactcacctgagggcggcggtcaaccaagagctggcgccggagtcggcgctggtcaggccaggcgacgaagtggcttttttcccacccgtcacaggagggtag

SEQ ID NO: 1656 - protein, 83 aa, Methylobacillus flagellatus KT
MIQLLYFARLREALGTESESLHWPEPATVSALMQSLATRGGVWEEQFSGNTHLRAAVNQELAPESALVRPGDEVAFFPPVTGG

SEQ ID NO: 1657 - DNA, 258 bp, Ralstonia metallidurans CH34
  CDS (1)..(258): transl_table=11
atgcaactagaactccgatacttcgccagcgtgcgcgaacaggtggggcagggcgccgaacgcgccgaggtgcccgccgaggttcgcacggttggcgacctgcgcgcatggctgcgcggacgcggcggcgcctggaccgaggctttggccgatggccgcgcgctgcgcatggccgtggaccacgccgtggcacgtgccgacaccccgctggccgacggctgcgaggtggcctttttccctcccgtgaccggaggctga

SEQ ID NO: 1658 - protein, 85 aa, Ralstonia metallidurans CH34
MQLELRYFASVREQVGQGAERAEVPAEVRTVGDLRAWLRGRGGAWTEALADGRALRMAVDHAVARADTPLADGCEVAFFPPVTGG

SEQ ID NO: 1659 - DNA, 246 bp, Silicibacter sp. TM1040
  CDS (1)..(246): transl_table=11
atggatgttctctattttgcatgggtgcgcgagcgcatcggcttgcccaaggaaacggtcgagacctctgccgtgacggtggcggaactggtcgaagagctgaaggcgcgcgaggagcgttatgctgcagcctttgcggatctctcggcgttgcgcgtggcactggatcaggagcttgcggagtttgatgcgcctctggagggcgtacgcgaggtggcgttctttccgccgatgaccggaggctga

SEQ ID NO: 1660 - protein, 81 aa, Silicibacter sp. TM1040
MDVLYFAWVRERIGLPKETVETSAVTVAELVEELKAREERYAAAFADLSALRVALDQELAEFDAPLEGVREVAFFPPMTGG

SEQ ID NO: 1661 - DNA, 246 bp, Haemophilus somnus 129PT
  CDS (1)..(246): transl_table=11
atgttaaaagtattattttttgcacaaacgagagagttaatcggtgttgatgaattagaggttaaagcggaatttgcaacagcagagcagttacgtcaacatctcagccaaaaaggtgataaatgggcattagctttagagaaagggaagctattggttgcgattaatcaaacgcttaaaccgttggaaagtgcggttcgttccggagatgaaattgcatttttcccacctgttacgggaggataa

SEQ ID NO: 1662 - protein, 81 aa, Haemophilus somnus 129PT
MLKVLFFAQTRELIGVDELEVKAEFATAEQLRQHLSQKGDKWALALEKGKLLVAINQTLKPLESAVRSGDEIAFFPPVTGG

SEQ ID NO: 1663 - DNA, 252 bp, Pseudomonas aeruginosa UCBPP-PA14
  CDS (1)..(252): transl_table=11
atgatccgcgtgcagtatttcgcccgttaccgagaagccctcggcgtcgacggcgagcagttgaactgggacgccgggctggcgaccctcggcgccttgcgccagctcctggtggagcgcggcggggcctgggagcgtaccctcggcgagcagaacctgatgtgcgcgcgcaatcaggaactgtgcggcctcgacgagccgttgcaggacggcgacgaagtcgccttcttccccaccgtcaccggaggttga

SEQ ID NO: 1664 - protein, 83 aa, Pseudomonas aeruginosa UCBPP-PA14
MIRVQYFARYREALGVDGEQLNWDAGLATLGALRQLLVERGGAWERTLGEQNLMCARNQELCGLDEPLQDGDEVAFFPTVTGG

SEQ ID NO: 1665 - DNA, 252 bp, Shewanella sp. ANA-3
  CDS (1)..(252): transl_table=11
atgattaacgtgttgttttttgcccaagttcgtgagcttttaggaactgcccaactgagtgttgaagcgagcgagcagacacaaaccgcagaaggattacgcgcaacactcgcggccaccgacgataaatgggccaaagtgttagcctcggacaaattgctggtggcggtgaatcaaaccatcagccagtgggatacccgtgtgagcgatggtgatgaagtcgccttcttcccgcctgtgacaggaggttga

SEQ ID NO: 1666 - protein, 83 aa, Shewanella sp. ANA-3
MINVLFFAQVRELLGTAQLSVEASEQTQTAEGLRATLAATDDKWAKVLASDKLLVAVNQTISQWDTRVSDGDEVAFFPPVTGG

SEQ ID NO: 1667 - DNA, 255 bp, Azoarcus sp. BH72
  CDS (1)..(255): transl_table=11
atgaacgtcaagatcctgttttttgccagcctgcgtgaagcgctgggaaccgcgtccgagtcctatacgttgccggccggcggcctcaccgtcggcaccctgcgggcggagctggcgctacgcggggagcgttggcaggcactggcgcccgggcgtaatgtgcgcgcggcggtgaatcagcgtatggccgggccggaggtggaactgcgccccggcgatgaagtggccttttttccgccggttaccggaggctga

SEQ ID NO: 1668 - protein, 84 aa, Azoarcus sp. BH72
MNVKILFFASLREALGTASESYTLPAGGLTVGTLRAELALRGERWQALAPGRNVRAAVNQRMAGPEVELRPGDEVAFFPPVTGG

SEQ ID NO: 1669 - DNA, 264 bp, Acidovorax sp. JS42
  CDS (1)..(264): transl_table=11
atgaccacgcccttcacgatcacggtgcgctacttcgcctccatccgcgaggccgtgggcatggggcaggagacggtgcagaccggcgccaccacgctgggcgccttgcgcgatgaactcatcgcccgtggcgagccctgggccacctgcctctcgcgcgggcgcgccgtgcgcgtggccctcgaccagaccatggcgcatgacgccacgccgctggcggcaggcgccgaggcggcgttctttccgcccgtcacgggcggctga

SEQ ID NO: 1670 - protein, 87 aa, Acidovorax sp. JS42
MTTPFTITVRYFASIREAVGMGQETVQTGATTLGALRDELIARGEPWATCLSRGRAVRVALDQTMAHDATPLAAGAEAAFFPPVTGG

SEQ ID NO: 1671 - DNA, 252 bp, Magnetospirillum magnetotacticum MS-1
  CDS (1)..(252): transl_table=11
atgaaggtgctgtacttcgcctggctgaaggccaagaccggactcggggaagaagacgtcactccgcccgacggcgtcgccaccgtgggtcaattggtggacttcctgaaaacccgctcgcccggccatgcggcggcgttcgaggtcatgagcacggtgcgtgtcgcggtgaaccaggattacggcggccttgatacgccggtgaagaccggcgacgaggtggcgttctttccccccgtgaccggaggctga

SEQ ID NO: 1672 - protein, 83 aa, Magnetospirillum magnetotacticum MS-1
MKVLYFAWLKAKTGLGEEDVTPPDGVATVGQLVDFLKTRSPGHAAAFEVMSTVRVAVNQDYGGLDTPVKTGDEVAFFPPVTGG

SEQ ID NO: 1673 - DNA, 246 bp, Haemophilus influenzae R2846
  CDS (1)..(246): transl_table=11
atgttaaatgttttattttttgctcaaactcgtgaattaattggcgttgatgccattcaattagaagatgattttgcgacagcagatgcggtgcgtgaataccttgctcaaaaaggcgatagatgggcgttagcgttagaaaaagggaagcttttagtggcaattaatcaaaccttaatgcctttagaaagtgcggtaaaaaatggcgatgaaattgcctttttcccaccagtaacagggggctaa

SEQ ID NO: 1674 - protein, 81 aa, Haemophilus influenzae R2846
MLNVLFFAQTRELIGVDAIQLEDDFATADAVREYLAQKGDRWALALEKGKLLVAINQTLMPLESAVKNGDEIAFFPPVTGG

SEQ ID NO: 1675 - DNA, 246 bp, Haemophilus influenzae R2866
  CDS (1)..(246): transl_table=11
atgttaaatgttttattttttgctcaaactcgtgaattaattggcattgatgccattcaattagaagatgattttgccactgcggaagcggtgcgtgaacaccttgctcaaaagggcgataaatgggcattggcactggaaaaaggtaaacttttagtggcaattaatcaaaccttaatgcctttagaaagtgcggtaaaaaatggcgatgaaattgcctttttcccaccagtaacagggggctaa

SEQ ID NO: 1676 - protein, 81 aa, Haemophilus influenzae R2866
MLNVLFFAQTRELIGIDAIQLEDDFATAEAVREHLAQKGDKWALALEKGKLLVAINQTLMPLESAVKNGDEIAFFPPVTGG

SEQ ID NO: 1677 - DNA, 228 bp, Haemophilus somnus 2336
  CDS (1)..(228): transl_table=11
ttgcacaaacgagagagattaatcggtgttgatgaattagaggttaaagcggaatttgcaacagcagagcagttacgtcaacatctcagccaaaaaggtgataaatgggcattagctttagagaaagggaagctattggttgcgattaatcaaacgcttaaaccgttggaaagtgcggttcgttccggagatgaaattgcatttttcccacctgttacgggaggataa

SEQ ID NO: 1678 - protein, 75 aa, Haemophilus somnus 2336
MHKRERLIGVDELEVKAEFATAEQLRQHLSQKGDKWALALEKGKLLVAINQTLKPLESAVRSGDEIAFFPPVTGG

SEQ ID NO: 1679 - DNA, 246 bp, Sulfitobacter sp. EE-36
  CDS (1)..(246): transl_table=11
atgaatatcttgtattttgcatgggttcgcgaacgtatcgggcttcctcgtgagaaggtcgagacgtcggcgcgcactgttctggatcttgtagaggaactgcgcgcgcgcgaagagcgctatgcggtcgccttttccgatctgtccggcctgcgtgtcgccgtggatcaggaacttgccgatttcgatgcctctttggaaggggtgcgcgaagtggcgtttttcccgccgatgacagggggttga

SEQ ID NO: 1680 - protein, 81 aa, Sulfitobacter sp. EE-36
MNILYFAWVRERIGLPREKVETSARTVLDLVEELRAREERYAVAFSDLSGLRVAVDQELADFDASLEGVREVAFFPPMTGG

SEQ ID NO: 1681 - DNA, 246 bp, Roseovarius nubinhibens ISM
  CDS (1)..(246): transl_table=11
atggacgttctgtatttcgcctgggtgcgcgagcgggtcggcctgccgaaagagcgggtcgagaccggggccgccacagtgcgcgagctggtggccgagctcaaggcgcgcgagccgcgctatgaggcggcctttgccgatgagggcgcgctgcgcgtggcggtggatcaagagctcaccgatttcgacgcgagcctgacgggtgcgcgcgaggtggcgttctttccaccgatgaccggcggctag

SEQ ID NO: 1682 - protein, 81 aa, Roseovarius nubinhibens ISM
MDVLYFAWVRERVGLPKERVETGAATVRELVAELKAREPRYEAAFADEGALRVAVDQELTDFDASLTGAREVAFFPPMTGG

SEQ ID NO: 1683 - DNA, 246 bp, Oceanicola batsensis HTCC2597
  CDS (1)..(246): transl_table=11
atggaggtactctatttcgcctgggtccgggaacggatcggcctgccgagggaacgggtcgagacccgggccgcgacggtctcggacctcgtggcggagctgacggcgcgggaagagcgctatgcggcggcgtttgccgatctctcggcgctgcgggtcgcgctggaccaggagctggcggagttcgacgcgcccctggacggggtgcgcgaggtcgccttcttcccgccgatgaccgggggctga

SEQ ID NO: 1684 - protein, 81 aa, Oceanicola batsensis HTCC2597
MEVLYFAWVRERIGLPRERVETRAATVSDLVAELTAREERYAAAFADLSALRVALDQELAEFDAPLDGVREVAFFPPMTGG

SEQ ID NO: 1685 - DNA, 246 bp, Photobacterium sp. SKA34
  CDS (1)..(246): transl_table=11
atgattaaggttcttttttttgcacaagtaaaagagcttgtcgatactgatagccttgaagttgatgccatttactctactgctgatgtgttacgtgaagcattgtcaacgcgtggcgaaaaatggcaattggcactagaatcaggcaagttgcttgttgctgtcaatcaaactatttgttcattagatacaccattaactgatggtgatgaagttgcattttttccaccagtaacagggggataa

SEQ ID NO: 1686 - protein, 81 aa, Photobacterium sp. SKA34
MIKVLFFAQVKELVDTDSLEVDAIYSTADVLREALSTRGEKWQLALESGKLLVAVNQTICSLDTPLTDGDEVAFFPPVTGG

SEQ ID NO: 1687 - DNA, 252 bp, Xanthobacter autotrophicus Py2
  CDS (1)..(252): transl_table=11
gtgaagatcctgtatttcgcctggctgcgcgagcgcgtcgggctcgcggaggaagaggtggcgccgcccgccgaggtggccaccgtggccgatctcgcgcgttggctcgccgggcgggacgaggcccacgcctacgccttcgagaatgcagccgtggtgcgcgccgccctcgatcggcgccacgtgaagccggatgcatccctcgccggggtgcgggaagtggccttcttcccgcccatgaccggaggctga

SEQ ID NO: 1688 - protein, 83 aa, Xanthobacter autotrophicus Py2
MKILYFAWLRERVGLAEEEVAPPAEVATVADLARWLAGRDEAHAYAFENAAVVRAALDRRHVKPDASLAGVREVAFFPPMTGG

SEQ ID NO: 1689 - DNA, 258 bp, Oceanobacter sp. RED65
  CDS (1)..(258): transl_table=11
atgaaaattcttttttttgcacaactgaaagaacaactagggatcgactcagtggatgtccatatctctgagcagaccaccgcaaaacaactgctacagcatttggtgaaggaaaatccacagtggcaagcttttcttgagcgagacgacctaatgtgtgccgtggatcaagtcatgttaagcccacaagacattcaaaaccagccgattgccaatactcaagaagtggccttttttccgccggtaacaggtggctag

SEQ ID NO: 1690 - protein, 85 aa, Oceanobacter sp. RED65
MKILFFAQLKEQLGIDSVDVHISEQTTAKQLLQHLVKENPQWQAFLERDDLMCAVDQVMLSPQDIQNQPIANTQEVAFFPPVTGG

SEQ ID NO: 1691 - DNA, 258 bp, Vibrio sp. Ex25
  CDS (1)..(258): transl_table=11
atgattaaagtacttttttttgctcagactcgtgagctgattggtatcgacagtgtcgaattagatgatcaatttgaaacggttgaagcgattcgcgcacatctcgtggaagagggcgctgataaaaatggtaagtgggatttggctttagagccaggaaagctacttgctgctgttaatcaatctattgtcccacttgataccgaagtaaaagcgggggatgaagttgcatttttcccaccggtaaccggaggttaa

SEQ ID NO: 1692 - protein, 85 aa, Vibrio sp. Ex25
MIKVLFFAQTRELIGIDSVELDDQFETVEAIRAHLVEEGADKNGKWDLALEPGKLLAAVNQSIVPLDTEVKAGDEVAFFPPVTGG

SEQ ID NO: 1693 - DNA, 300 bp, Alteromonadales bacterium TW-7
  CDS (1)..(300): transl_table=11
atggcagctggcagcgagactaatttaaataatacgaatgcagctgcagggcatgttatcgtactcttttttggccaactaaaagagcggctaaagtgcgacaagttaaccgttgatatagcgcatacccttagcattaaagcgtttaaacacatgctggttgagcaaaacccacattggcaggcatggcttgaagagcgtgatgtattgtgtgcgcttaatcaaactatgtcatcaagcgatgagcttgtaaaagcaggggatgaacttgcttttttcccaccagtgacaggtggctaa

SEQ ID NO: 1694 - protein, 99 aa, Alteromonadales bacterium TW-7
MAAGSETNLNNTNAAAGHVIVLFFGQLKERLKCDKLTVDIAHTLSIKAFKHMLVEQNPHWQAWLEERDVLCALNQTMSSSDELVKAGDELAFFPPVTGG

SEQ ID NO: 1695 - DNA, 255 bp, marine gamma proteobacterium HTCC2143
  CDS (1)..(255): transl_table=11
atggtgcaagtcatgtttttctcgctaattcgagagcggcttgataccgataagttgtcgttaagtttacccatgccgggaatgaccttgctagcattcaccgaacacctaattgatacgcatgatgctcattggcgagaggtgttaacttcagccaatatcatcaagtccgttaatcagcgcgttgttgataatgattgctgtctgtctgatggcgacgagattgccttctttccgcccgttaccggaggatag

SEQ ID NO: 1696 - protein, 84 aa, marine gamma proteobacterium HTCC2143
MVQVMFFSLIRERLDTDKLSLSLPMPGMTLLAFTEHLIDTHDAHWREVLTSANIIKSVNQRVVDNDCCLSDGDEIAFFPPVTGG

SEQ ID NO: 1697 - DNA, 255 bp, marine gamma proteobacterium HTCC2080
  CDS (1)..(255): transl_table=11
atgctaaccgtgcgctttttttcattgatccgtgaggcgctcgattgcgaagaactacaggtggagcatcaggagaccctgtgcacagttggtgatcttaagcagagtctggtagataacggaggggatcattggcgtgaggcactgtatcagcccaatgtagtgcatgccctcaaccagcgtgttgtgaacacagatcacgaattgaaagatggcgatgaggtggcgttttttccacccatgactggcggttga

SEQ ID NO: 1698 - protein, 84 aa, marine gamma proteobacterium HTCC2080
MLTVRFFSLIREALDCEELQVEHQETLCTVGDLKQSLVDNGGDHWREALYQPNVVHALNQRVVNTDHELKDGDEVAFFPPMTGG

SEQ ID NO: 1699 - DNA, 246 bp, Pseudomonas putida GB-1
  CDS (1)..(246): transl_table=11
atgaaggtcaaggtgagttattttgcccgttaccgcgagctgctgggcgtggatgccgagcatgtagagggcgcgttcaaggtgctggacgatgtccgccaggtcctggtggccaagggcgggcaatatgcggtgctggccgagcagaacctgatgtccgcgcgtaacgaagaactgtgcaaactcgacgagccgctggcagagggtgatgaagtggcgtttttcccgccggtgaccggaggctga

SEQ ID NO: 1700 - protein, 81 aa, Pseudomonas putida GB-1
MKVKVSYFARYRELLGVDAEHVEGAFKVLDDVRQVLVAKGGQYAVLAEQNLMSARNEELCKLDEPLAEGDEVAFFPPVTGG

SEQ ID NO: 1701 - DNA, 26 bp, Artificial sequence
  primer
atgattaaagttctttttttcgccca

SEQ ID NO: 1702 - DNA, 21 bp, Artificial sequence
  primer
ttaacctccggttaccggcgg

SEQ ID NO: 1703 - protein, 85 aa, Artificial sequence
  consensus sequence
  Variant (3)..(4): Xaa in position 3 to 4 is any amino acid
  Variant (7)..(8): Xaa in position 7 to 8 is any amino acid
  Variant (10)..(20): Xaa in position 10 to 20 is any amino acid
  Variant (21)..(22): Xaa in position 21 to 22 is any or no amino acid
  Variant (24)..(30): Xaa in position 24 to 30 is any amino acid
  Variant (32)..(45): Xaa in position 32 to 45 is any amino acid
  Variant (46)..(53): Xaa in position 46 to 53 is any or no amino acid
  Variant (55)..(55): Xaa in position 55 is any amino acid
  Variant (57)..(70): Xaa in position 57 to 70 is any amino acid
  Variant (71)..(74): Xaa in position 71 to 74 is any or no amino acid
  Variant (76)..(76): Xaa in position 76 is any amino acid
FAXXREXXGXXXXXXXXXXXXXTXXXXXXXLXXXXXXXXXXXXXXXXXXXXXXAXNXXXXXXXXXXXXXXXXXXEXAFFPPVTGG

SEQ ID NO: 1704 - protein, 28 aa, Artificial sequence
  protein pattern
  Variant (2)..(2): Xaa in position 2 is any amino acid
  Variant (3)..(3): Xaa in position 3 is Asp or Asn
  Variant (4)..(9): Xaa in position 4 to 9 is any amino acid
  Variant (10)..(10): Xaa in position 10 is Asp, Glu, Gly or Thr
  Variant (11)..(12): Xaa in position 11 to 12 is any amino acid
  Variant (13)..(13): Xaa in position 13 is Ile, Leu or Val
  Variant (14)..(17): Xaa in position 14 to 17 is any amino acid
  Variant (19)..(19): Xaa in position 19 is Ile, Leu or Val
  Variant (24)..(24): Xaa in position 24 is Pro, Gln or Thr
  Variant (25)..(25): Xaa in position 25 is Leu, Met or Val
AXXXXXXXXXXXXXXXXEXAFFPXXTGG

SEQ ID NO: 1705 - DNA, 1659 bp, Escherichia coli
  CDS (1)..(1659): transl_table=11
atgatcatgttttgtgtgcaatgtgaacaaactatccgtactccggcaggaaacggctgctcatacgcgcaggggatgtgtggtaaaacggcggaaacttctgaccttcaggatttactcatcgcggcgctgcaagggctttctgcctgggcggtaaaagcgcgtgaatacggcatcatcaaccacgatgttgacagcttcgcgccacgtgcctttttctcaaccctgaccaacgttaacttcgattctccgcgtattgtcggctacgctcgtgaagcgattgccctgcgcgaggcgctgaaagcgcaatgcctggctgtagatgccaacgcgcgcgtcgataacccgatggctgacctgcaactggtgagcgacgatctcggcgagctgcaacgtcaggcagcagaatttacccctaacaaagataaagcggcgattggcgaaaacattctcggcctgcgtctgctgtgcctgtatggcctgaaaggtgcggcggcctatatggaacacgcgcatgttctcggtcaatacgacaacgatatttatgcccagtaccataaaatcatggcgtggctggggacctggcctgccgatatgaacgcgcttcttgagtgttcaatggaaatcggccagatgaacttcaaagtgatgagcattctggatgcaggcgaaaccggtaaatacggtcacccgacgccaacccaggtcaacgtcaaagcgacggcgggtaaatgcattctgatttccggtcacgatctcaaagatctctacaacctgctggaacagaccgaaggcacgggcgttaatgtctacacccacggcgaaatgctgcctgcgcatggctacccggagctgcgtaaattcaagcatctggtcggtaactacggcagcggctggcagaatcagcaagtggagttcgctcgtttccctggccccatcgtgatgacctcgaactgcatcatcgacccaaccgtaggcgcttatgacgatcgtatctggacccgcagcattgttggctggcctggcgtgcgtcatctggacggtgatgatttctctgcggttatcacccaggcgcaacagatggcaggcttcccgtacagcgaaattccgcaccttatcaccgtgggttttggtcgccagacgctgcttggcgctgctgatacgctgattgatctggtgagccgtgaaaaactgcgtcatatcttcctgcttggtggctgtgacggcgcacgcggcgagcgccactacttcaccgatttcgccaccagcgtgccggatgactgcctgatcctgaccctcgcctgtggtaaatatcgctttaacaaacttgagtttggcgatatcgaaggtctgccgcgtctggtagatgcaggtcaatgtaacgatgcttactcagcgattattctggctgtcactctggcagagaaactgggctgcggtgtcaacgatctgccgctgtcgctggtgctctcctggtttgaacagaaagcgatcgtcattctgctgacgctgctttctctgggcgtgaaaaatatcgtcaccggcccgactgcacctggtttcctgacaccagacctgctggcggtgctgaacgagaaattcggcctgcgttctatcaccactgttgaagaagacatgaagcaactgttgagcgcgtaa

SEQ ID NO: 1706 - protein, 552 aa, Escherichia coli
MIMFCVQCEQTIRTPAGNGCSYAQGMCGKTAETSDLQDLLIAALQGLSAWAVKAREYGIINHDVDSFAPRAFFSTLTNVNFDSPRIVGYAREAIALREALKAQCLAVDANARVDNPMADLQLVSDDLGELQRQAAEFTPNKDKAAIGENILGLRLLCLYGLKGAAAYMEHAHVLGQYDNDIYAQYHKIMAWLGTWPADMNALLECSMEIGQMNFKVMSILDAGETGKYGHPTPTQVNVKATAGKCILISGHDLKDLYNLLEQTEGTGVNVYTHGEMLPAHGYPELRKFKHLVGNYGSGWQNQQVEFARFPGPIVMTSNCIIDPTVGAYDDRIWTRSIVGWPGVRHLDGDDFSAVITQAQQMAGFPYSEIPHLITVGFGRQTLLGAADTLIDLVSREKLRHIFLLGGCDGARGERHYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFLTPDLLAVLNEKFGLRSITTVEEDMKQLLSA

SEQ ID NO: 1707 - DNA, 1593 bp, Clostridium difficile 630
  CDS (1)..(1593): transl_table=11
atggaaaaaatgttttgttttcaatgtgaacaaacagcaggaggtaaaggttgtactataaatggtgtatgtggtaaaaaggggggtacagctaacttacaagacgaacttacaggagtgttgattggtctttcaagagcaactattggaaataagaatagaccaacaagtgaaacagataaaattatgatagaggggctattcactactataacgaatgtaagttttgatgatgaagctataaaaagacaaattgaaaaaactgaggtagaaaaaagtaagcttgtacctagatgttcagattgttcaacaacttgtaatagaaatgataactatgatatgaaggatttatggaatgataatgaggacatacgttcattaaaatcattaatcttatttggattaagaggtatggctgcctatgcatatcatgcaatggtacttggttatacagacaaagacgtaaatgaatttttctatgaaggattaatagcagttggaggagacttgtctattgacgaacttttaggtctagttatgaaaactggagaaataaacttaaaatgtatggaattgcttgatagagcaaatactgaaacttatggaacaccagaacctacacaggtatctatgaaaatcgagaaagggccatttattgtagttacaggacatgacctttatgatttacacaaattattagaacaaacgaaagataagggtataaatatatatactcatggtgagttattaccagcacatgcatatccaaaactaaaagaatataaacatctaaaaggtaattttggtacagcatggcaaaaccagcaaaaagaatttgataatattcctgctccaatattatttacaacaaactgtttaatgcctgttaaagatagttatagagatagagtatttactacagaagtagttgcttatccaggtatggttcatattgatgaagataaagatttttctagtgtaatagaaaaagctcttgaacttggaggatatagagaagatgttcatatgactggtattaatggaggagatacattaactactggttttgcaagaggtacagtttcatctgtacaagataaagtagtagatgctgtaaagagtggagctataagacactttttattggttggaggttgtgatggtgcaaaacctggaagaaattattacactgaatttgtaaaacaagctcctaaagacactgttatattgacacttgcatgtggaaaatatagatttaatgatttagaccttggggatataggtggcttacctcgtttaatggatatgggacaatgtaatgatgcttatagtgcaattaaagtggcagtttcattggcaaatgcttttgaatgtggagtaaatgatttgcctcttagcatggtactgtcatggtatgagcagaaagctgtttgtatacttcttacactacttcatttaggtatcaaaaatatctatataggaccttctttaccagcattcttatctaagaatgtattagatatattggttgataaatttgcattgacacctatatctactcctgaagaagatatgaagaagattttaggataa

SEQ ID NO: 1708 - protein, 530 aa, Clostridium difficile 630
MEKMFCFQCEQTAGGKGCTINGVCGKKGGTANLQDELTGVLIGLSRATIGNKNRPTSETDKIMIEGLFTTITNVSFDDEAIKRQIEKTEVEKSKLVPRCSDCSTTCNRNDNYDMKDLWNDNEDIRSLKSLILFGLRGMAAYAYHAMVLGYTDKDVNEFFYEGLIAVGGDLSIDELLGLVMKTGEINLKCMELLDRANTETYGTPEPTQVSMKIEKGPFIVVTGHDLYDLHKLLEQTKDKGINIYTHGELLPAHAYPKLKEYKHLKGNFGTAWQNQQKEFDNIPAPILFTTNCLMPVKDSYRDRVFTTEVVAYPGMVHIDEDKDFSSVIEKALELGGYREDVHMTGINGGDTLTTGFARGTVSSVQDKVVDAVKSGAIRHFLLVGGCDGAKPGRNYYTEFVKQAPKDTVILTLACGKYRFNDLDLGDIGGLPRLMDMGQCNDAYSAIKVAVSLANAFECGVNDLPLSMVLSWYEQKAVCILLTLLHLGIKNIYIGPSLPAFLSKNVLDILVDKFALTPISTPEEDMKKILG

SEQ ID NO: 1709 - DNA, 1647 bp, Methanocaldococcus jannaschii DSM 2661
  CDS (1)..(1647): transl_table=11
atgaaatttgaaccaagacctacaaaaatgttctgcttccaatgtcaagaggcagcaaaaaatgaaggatgtacaataaaaggagtctgtggaaaagatgatgttgtggcaaacctccaagatttattgatttatactataaaaggtttatgctatgtctgtgataaaggcaattacttggatgatgaagttatggattacattccaaaagcattatttgtaacaataactaacgtcaattttgatgataaagatgtaataaattggataaagaaaggagtcgctttaagagaaaaaattatagaaaaaaataatttaaataaagaagaacttccatactgtgctacttgggcttacgaaactgatgaagatctaataaatttagccaatacaaaagaagttagcgtcttagcagaggataatgaagacataagatcattaaaagagcttataacttatggaattaaaggaataggagcttatctaagccatgccatgcatctcggctacaacaatgaggacattcataagtttataattaaagcattcactaaaatcgttgatagcaaagatgctgatgagttatttaatttagcaatggagacaggaaagtatgcagtagaaacgttagcattattagataaagcgaacactgaaacctatgggcatccagaaataacagaggttaatttgggagttagagacagaccaggaatattgattagtggtcacgacttaaaagatttagagcaattattagagcaaagtaaggatgcaggagttgatatctacacccactgtgagatgttgccagcccactactacccattctttaagaaatatgagcacttcgttggaaattatggaggttcatggccgttccaaagagaggaatttgagaaattcaacggtccaatagtgatgacgacaaactgtttagttccaccaaaggactcatataaagatagggtttatgtaaccaacgaagttggctatcctggcttaaagagaatcccagtaaaagaggatggaactaaggacttttcagaggttatagagcacgctaaaaaatgcaaaccaccaacaccactcgaaaatggtaagattgttggaggattcgctcataaccaagttttagcactggcagataaagtaattgaagcagttaaaagtggaaaaataaggaaattcgttgtaatggccggatgtgatggaaggcataaaacaagagagtattatactgaatttgctaaaaaactgcctaaagatactgttatattaacatgtggatgtgcaaaatatagatttattaaattagatttgggagacattgatggaattccaagagttttagatgctggacagtgtaatgatagctattcgttagttaaaattgcactggctttaaaagatgcatttggcttaaacgatgtaaatgaacttccaatcgcttataacatctcatggtatgagcaaaaggcagttactgtattattagctttgctttacttgggagttaagaatatagtattaggccctacactaccagcgttcttatcaccaaatgtgacaaaagttttagttgagaagtttggaatctcaacgatctcaacagttgatgaagatattaaaagattagttgggtaa

SEQ ID NO: 1710 - protein, 548 aa, Methanocaldococcus jannaschii DSM 2661
MKFEPRPTKMFCFQCQEAAKNEGCTIKGVCGKDDVVANLQDLLIYTIKGLCYVCDKGNYLDDEVMDYIPKALFVTITNVNFDDKDVINWIKKGVALREKIIEKNNLNKEELPYCATWAYETDEDLINLANTKEVSVLAEDNEDIRSLKELITYGIKGIGAYLSHAMHLGYNNEDIHKFIIKAFTKIVDSKDADELFNLAMETGKYAVETLALLDKANTETYGHPEITEVNLGVRDRPGILISGHDLKDLEQLLEQSKDAGVDIYTHCEMLPAHYYPFFKKYEHFVGNYGGSWPFQREEFEKFNGPIVMTTNCLVPPKDSYKDRVYVTNEVGYPGLKRIPVKEDGTKDFSEVIEHAKKCKPPTPLENGKIVGGFAHNQVLALADKVIEAVKSGKIRKFVVMAGCDGRHKTREYYTEFAKKLPKDTVILTCGCAKYRFIKLDLGDIDGIPRVLDAGQCNDSYSLVKIALALKDAFGLNDVNELPIAYNISWYEQKAVTVLLALLYLGVKNIVLGPTLPAFLSPNVTKVLVEKFGISTISTVDEDIKRLVG

SEQ ID NO: 1711 - DNA, 1659 bp, Escherichia coli CFT073
  CDS (1)..(1659): transl_table=11
gtgatcatgttttgtgtgcaatgtgaacaaactatccgtactccggcaggaaacggctgctcatacgcgcaggggatgtgtggcaaaacggcggaaacctctgaccttcaggatttactcatcgcgacgctgcaagggctttcggcctgggcagtgaaagcacgtgaatacggcatcatcaaccacgatgtagacagctttgcgccacgtgcctttttctcaaccctgaccaacgttaacttcgattctccgcgtattgtcggctacgctcgtgaagcgattgccctgcgcgaggcgctgaaagcacaatgcctggctgtagatgccaacgcccgcgtcgataacccgatggctgacctgcaactggtgagcgacgatctcggcgagctgcaacgtcaggcagcagaatttacccctaacaaagataaagcggcgattggcgaaaacattctcggcctgcgtctgctgtgcctgtatggcttgaaaggtgcggcggcctatatggaacacgcgcatgttctcggtcaatacgacaacgatatttatgcccagtaccataaaatcatggcgtggctggggacctggcctgccgatatgaacgcgcttcttgagtgttcaatggaaatcggccagatgaatttcaaagtgatgagcattctggatgcaggcgaaaccggtaaatacggtcacccgacgccaacccaggtcaacgtcaaagcgacggcgggtaaatgcattctgatttccggtcacgatctcaaagatctctacaacctgctggaacagaccgaaggcacgggcgttaatgtctacacccacggcgaaatgctgcctgcgcatggttacccggagctgcgtaaattcaagcatctggtcggtaactacggcagcggctggcagaatcagcaagtggagttcgctcgtttcccaggccccatcgtgatgacctcgaactgcatcatcgacccaaccgtaggcgcttatgacgatcgtatctggacccgcagcatcgttggctggccgggtgtgcgtcatctggatggcgaagatttctctgcggtcattgcccaggcgcaacagatggcgggcttcccgtacagcgaaattccgcacctgatcaccgtgggctttggtcgccagacactgcttggcgcagccgatacgctgattgatctggtgagccgtgaaaaactgcgtcatatcttcctgcttggcggctgtgacggcgcacgcggcgagcgtcactacttcaccgatttcgccaccagcgtgccggatgactgcctgatcctgaccctcgcttgcggtaaatatcgctttaataaacttgagtttggcgatatcgaaggtctgccgcgtctggtagatgctggtcagtgtaacgatgcttactcagcaattattctggcggtaacgctggcagagaaactgggctgtggggtgaacgatctgccgctgtcgctggtgctctcctggtttgaacagaaagcgattgtcattctgctgacgctgctttctctgggtgtgaaaaatatcgtcaccggcccaactgcacctggtttcctgacaccagacctgctggcggtgctgaacgagaaattcggcctgcgttctatcaccactgttgaagaagacatgaagcaactgttgagcgcgtaa

SEQ ID NO: 1712 - protein, 552 aa, Escherichia coli CFT073
MIMFCVQCEQTIRTPAGNGCSYAQGMCGKTAETSDLQDLLIATLQGLSAWAVKAREYGIINHDVDSFAPRAFFSTLTNVNFDSPRIVGYAREAIALREALKAQCLAVDANARVDNPMADLQLVSDDLGELQRQAAEFTPNKDKAAIGENILGLRLLCLYGLKGAAAYMEHAHVLGQYDNDIYAQYHKIMAWLGTWPADMNALLECSMEIGQMNFKVMSILDAGETGKYGHPTPTQVNVKATAGKCILISGHDLKDLYNLLEQTEGTGVNVYTHGEMLPAHGYPELRKFKHLVGNYGSGWQNQQVEFARFPGPIVMTSNCIIDPTVGAYDDRIWTRSIVGWPGVRHLDGEDFSAVIAQAQQMAGFPYSEIPHLITVGFGRQTLLGAADTLIDLVSREKLRHIFLLGGCDGARGERHYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFLTPDLLAVLNEKFGLRSITTVEEDMKQLLSA

SEQ ID NO: 1713 - DNA, 1653 bp, Geobacter sulfurreducens PCA
  CDS (1)..(1653): transl_table=11
atgggaatgttctgtaaccagtgcgaacaggccgccaagggcgtcggctgcgagatcatgggagtctgcgggaaaaatcccgaggtcgccgcgctgcaggatctgatgctctacgggctcaaggggctagccatttacgccgacaaggcccgcgaactgggagccagggacgaggccatcgacctcttcatgatcgaagggctcttcactaccgtcaccaacgtggacttcgatccggtcagcctcgcgggcaagctccgcacctgctacgacatgaaggaaaaggccaagtccctctatgaaaccgcctaccgcgagaagaacggcggccacgctccggcaatcgctgccggtcccgccgcctgggtcatcgccagcgatctcgaagggctcgtgaagcagggactcgagcacggcatcaacacccaccacacggacgccgacgtgcgctctgccatcgagatcctcatctacggcctcaagggaatggcggcctacgctgaccacgcctacatcctcggcaagaaggacgaagaggtcttcgccttcttccacaaagccatggccgccaccgccgacccggccaaggggctcatggacttcgtggggctctccatggagtgcggcaagctcaacatcaaggtcatggggatgctgaacgaagggcacgtggaccactacggccacccggtccccaccaaggtgcccaccggcacccggaggaacaaggggattctcgtgtcgggccacgacctgcgcatgcttgaagaactcctcaagcagaccgccggcaaggggatcgacatctacacccacggcgagatgctcccggcccacggctatccgggcctgaagcagaagtatccgcatctctacggcaatttcggcggcgcgtggcaggatcaggccaaggaattccccctcttccccggcgccatcatcttcaacaccaactgcatccaacggccggccgactcttacaaggaccgtctcttctcctggggacaggtgggatggcccggcgtgaagcacatctccggctgggacttctccgaggtcatcaacaaggctcttgagtgccccgagctggcagacgcgccggagaaggaaatcctcaccggcttcggccacaacgccgtcctcggcgtcgccgacaaggtcatcgaaggggtgaaggcaggcgccatcaagcacttcttcctcatcggcggctgcgacggcgccaagccgggccgcaactactacaccgaactggccgagaaggtgccccaggactgcgttatcctgaccctcgcctgcggcaagtaccgcttcaacaagctcgagttcggcgacatcggcggcatcccgcgactgctggacatcggccagtgcaacgatgcctactcggccctccagatcgccctggccctggccaacgccttcaactgcggcgtgaacgatctgcccctgtccatgatcctttcctggtatgagcagaaggcggtggtcatcctcctgtcgctgctccacctggggatcaggaacatcaagatcggccccagcctcccggccttcgtcaccccgaacgtcctcaacttcctggttgagaacttcaacctgggccccatcaccacggtggaagccgacctcaaggcagccctcggccagtaa

SEQ ID NO: 1714 - protein, 550 aa, Geobacter sulfurreducens PCA
MGMFCNQCEQAAKGVGCEIMGVCGKNPEVAALQDLMLYGLKGLAIYADKARELGARDEAIDLFMIEGLFTTVTNVDFDPVSLAGKLRTCYDMKEKAKSLYETAYREKNGGHAPAIAAGPAAWVIASDLEGLVKQGLEHGINTHHTDADVRSAIEILIYGLKGMAAYADHAYILGKKDEEVFAFFHKAMAATADPAKGLMDFVGLSMECGKLNIKVMGMLNEGHVDHYGHPVPTKVPTGTRRNKGILVSGHDLRMLEELLKQTAGKGIDIYTHGEMLPAHGYPGLKQKYPHLYGNFGGAWQDQAKEFPLFPGAIIFNTNCIQRPADSYKDRLFSWGQVGWPGVKHISGWDFSEVINKALECPELADAPEKEILTGFGHNAVLGVADKVIEGVKAGAIKHFFLIGGCDGAKPGRNYYTELAEKVPQDCVILTLACGKYRFNKLEFGDIGGIPRLLDIGQCNDAYSALQIALALANAFNCGVNDLPLSMILSWYEQKAVVILLSLLHLGIRNIKIGPSLPAFVTPNVLNFLVENFNLGPITTVEADLKAALGQ

SEQ ID NO: 1715 - DNA, 1632 bp, Treponema denticola ATCC 35405
  CDS (1)..(1632): transl_table=11
atggacactatgttttgttttcaatgtcaggagacatttaaaaattcaggctgcgtaagggtcggagtatgcgggaaaaaccccttagttgcaggattacaggactttctcatctggggaacaaaaaagctttccgaggtgacaagttatatgagggaaaacgggattaaggttgaaaaagaaattaaccacatcgtaagcacaaacctttttgttacaataaccaatgcaaattttgatgaaaaagcaattaacaacagaataaatattactcttaaagcaatccatgatttgcatagttctttaaaccgcccctttgatccggagattgaagtgtatattgactcggatataccgaaaagactgggcaaggccattacaataggcgttttgcagacaaaagatcccgataagcgctccttaaaagaacttattatctatggtctaaaggggctatgtgcctatgtaaaacatgctaacgccttaggctatgaagacgaagaggttgatgcctttattcaaaaaacgctttcaatgctcatagatgaaaaattgagtgttgatgaacttatttctcttaccttaaagacaggagaagcaggagttaagggaatggctctgctggatagcgccaacacaggcagctacggtaaccccgaaataaccgaagtttcgataggtgtaagaaataatccgggcatccttgtatctgggcatgatctaaaagatatcgaaatgcttcttgagcaaactgagggtacaggcgttgatgtttatactcactccgaaatgctccctgcaaattattatccgaaactaaaaaaatataagcatcttgcaggtaattacggtaattcgtgggccaaacaggtttccgaatttgaaagttttaacggcccaatccttatgacaaccaactgtataattccttcaaaggcttcctacgtatcaagaatgtacacgacaaatgcagcaggacatcccggctgtgttcatatcgaagccgatgaaaacggacataaggacttttccgaaattataaaaaaggcaaaatcctgtccgcccccaaaagaaattgaaagcggaaagattataggcggcttcgctcacgcccaagtttttgctcttgccgacaaaattgtcgaaagcgtaaaaaacggagatattagaaaattcatagtaatgggcggctgtgacggcaggcacacaacaagatcttattatacgggttttgcagaagctcttccaaaaaataccgtcattctaacggcaggctgtgcaaaatacaggtataataaattaaatcttggagatataaacggcattccaagggtattggatgcaggacagtgcaatgattcttattcccttgcccttatagctcttaaattgaaggaaatatttaacctaagcgatattaatgatttacctataatttttaatatagcatggtacgaacaaaaagccgttatagtactcttggccctattgttcttaggcgtaaaaaacatacaccttgggcctactattcccggcttcctttcacccaacgtaaaggatgttttaataagcaaattcggattatcgggaatctcttcaatagaagatgatataaaacattttttcggttag

SEQ ID NO: 1716 - protein, 543 aa, Treponema denticola ATCC 35405
MDTMFCFQCQETFKNSGCVRVGVCGKNPLVAGLQDFLIWGTKKLSEVTSYMRENGIKVEKEINHIVSTNLFVTITNANFDEKAINNRINITLKAIHDLHSSLNRPFDPEIEVYIDSDIPKRLGKAITIGVLQTKDPDKRSLKELIIYGLKGLCAYVKHANALGYEDEEVDAFIQKTLSMLIDEKLSVDELISLTLKTGEAGVKGMALLDSANTGSYGNPEITEVSIGVRNNPGILVSGHDLKDIEMLLEQTEGTGVDVYTHSEMLPANYYPKLKKYKHLAGNYGNSWAKQVSEFESFNGPILMTTNCIIPSKASYVSRMYTTNAAGHPGCVHIEADENGHKDFSEIIKKAKSCPPPKEIESGKIIGGFAHAQVFALADKIVESVKNGDIRKFIVMGGCDGRHTTRSYYTGFAEALPKNTVILTAGCAKYRYNKLNLGDINGIPRVLDAGQCNDSYSLALIALKLKEIFNLSDINDLPIIFNIAWYEQKAVIVLLALLFLGVKNIHLGPTIPGFLSPNVKDVLISKFGLSGISSIEDDIKHFFG

SEQ ID NO: 1717 - DNA, 1641 bp, Methanococcus maripaludis S2
  CDS (1)..(1641): transl_table=11
atggaaagaccaacaaaaatgtattgtaatcaatgccaggaaacagttaaaggaacaggctgtgttaaagttggagtttgtggaaaaaaggacaatgtagccaatcttcaagaccttttaatttatactttaaaaggtatttcatacgtatctgaaaaaacaggggaaaataatggagctatcgatagatatattgtagattcgctctttgcatcagttacaaataccaactttgatgacaaatacttgattgaaaatgtaaaagaaggtttgaagttaagggatagtttaaaatcaaaatgtggcggaaattgcgggcaattgcctgattttgcaacgtggaatgcaaaaacagatttagaaattttagaaaaatcaaattcaaaagaagtttctttgcaggcaactgaaaatgaggatataagagctttaagagttactacactttacgggttaaaaggaattgctgcataccttcaccatgcaatggttcttggtgaaaacagtggtgaaattcacaaatttatcaaaaaagcgctgattgatatttctgatgattcaaaatccgccgatgaattaactgcgctggttcttgaaactggaaaatatgctgtagatacaatggcacttttggataaagcaaatactacaaaatatggaaatcctgaaataactgaagttgatatcggagttagggaaaatccaggtattttaataagcggtcatgatttaaaagacatggaagaccttttagaacagacaaaaggaacgggaattgatgtatatacccacagtgaaatgcttccagcacactactaccctgaatttaaaaaatacgaacattttgcaggaaattatggggggtcatggtataaacaaaaaacggagtttgaatcgtttaatggaccaattctaatgactacaaactgtattgtaccgcctgcagacagttatgtcgatagaatttatacaacgggcgttgttggatacccgggacttaaatatattccaacagttaacggcaaaaaagacttttcagaagtaattgaacaggctaaaaaatgtccatcacccgtagaacttgaaactggaaaaatagtcggtggttttgcacacaatcaggtactcgcgcttgctgacaaggtggttgatgcagtaaaatctggcgcaataaaaaaattctttgtaatggcaggatgcgacggacgaaatagcgatagggaatattacacggaatttgcaaaaaatcttccaaaagacacggtgattttaaccgcaggctgtgcaaaataccggtacaataaattaaatcttggagatatcgggggaattccaagagttctcgatgcaggtcagtgcaatgactgttattcactagcagtaattgctttaaaattaaaagaagtgtttgaactcgacgacataaacaagcttccaattgcattcaatattgcgtggtacgagcaaaaagcagtagctgttttacttgcactcctttatcttggaattaaaaatatccatgtaggcccaacacttccggaattcctttcgccaaacgttgcaaaagtattaattgataaatttgaacttggcggaataagcagcgtggaagaggatatgaagatgtttttaggagaataa

SEQ ID NO: 1718 - protein, 546 aa, Methanococcus maripaludis S2
MERPTKMYCNQCQETVKGTGCVKVGVCGKKDNVANLQDLLIYTLKGISYVSEKTGENNGAIDRYIVDSLFASVTNTNFDDKYLIENVKEGLKLRDSLKSKCGGNCGQLPDFATWNAKTDLEILEKSNSKEVSLQATENEDIRALRVTTLYGLKGIAAYLHHAMVLGENSGEIHKFIKKALIDISDDSKSADELTALVLETGKYAVDTMALLDKANTTKYGNPEITEVDIGVRENPGILISGHDLKDMEDLLEQTKGTGIDVYTHSEMLPAHYYPEFKKYEHFAGNYGGSWYKQKTEFESFNGPILMTTNCIVPPADSYVDRIYTTGVVGYPGLKYIPTVNGKKDFSEVIEQAKKCPSPVELETGKIVGGFAHNQVLALADKVVDAVKSGAIKKFFVMAGCDGRNSDREYYTEFAKNLPKDTVILTAGCAKYRYNKLNLGDIGGIPRVLDAGQCNDCYSLAVIALKLKEVFELDDINKLPIAFNIAWYEQKAVAVLLALLYLGIKNIHVGPTLPEFLSPNVAKVLIDKFELGGISSVEEDMKMFLGE

SEQ ID NO: 1719 - DNA, 1629 bp, Clostridium thermocellum ATCC 27405
  CDS (1)..(1629): transl_table=11
atgagcatgttttgttatcaatgtcaggaaactgcaggaggaaaaggctgcacagtacgcggggtgtgcggcaagaatgaggaagttgcaaagctccaggatcttttgctttacaccgttaaaggcatctcatatatcgttaccaagggaaatattgatgccgcaaaacttggaaatacaaaccatgaagtattaagcagcctgtttatgacaattaccaatgtgaattttgacgatggttcaattgaaaaacagataagaaaaatgcttgccgtaagggacgaaatgaaaaagtccgtacaggcggaaggccttcatgatgcggcggtattttctgtggattcaagagaatccatgttaaaaaaagccgattctgtgggggtactctccactcaaaatgaagatatacgttcattaagagaaatgattacctatggtgtcaagggtatggcagcctatgccgagcatgcgaaaaatataggaaaagaagacaaggaaatctattcctttatatatgaggctttggcggcaactttggacgactctctttcagttgacgacctttttgcgctgacactcaaaaccggtgaatacggtgtaaaggttatggcgcttctggacgaggccaatacatcaaggttcggaaatccggaaattaccgaagttaatatcggagtcagaaaaaatccggccatccttgtttccgggcatgaccttaccgatcttgaacagcttttggagcagacaaaaggaacaggcgtggatgtatacacccatggcgaaatgcttccggcccactactatccggctttcaaaaagtatgacaatttcgtgggcaactacggaaacgcatggtggaagcaggtggaagaatttgagtccttccacgggcctattttgtttactacaaactgtattgttccgccaaggagcgaagaggtcagaagaaggatatttacaacaggttcggcaggtttccccggatgcaagcatattgaagccgatgaaaacggcaagaaggatttttcggagataattgagcttgcgaaaactttgcctgctcctgatgaaattgaaacgggaagcattgtcggcggatttgcccacaatcaggtaatggcccttgccgacaaggtggttgaagccgtcaaatccggagctgttaaaaagttctttgttatggccggatgcgatgggcgcatgaagtccagaagttattacaccgagtttgcccaaaaccttcctaaagacactgtgattttaacggcaggatgtgcaaaatatcgttataacaagttgggactgggcgatataggcggtattccgagggtgcttgatgccggacagtgcaacgattcgtattctttggcggttattgccctgaaacttaaagaagtatttggactggacgatatcaacaagcttccgattgcctttaatatagcgtggtatgagcagaaagccgtaatagttcttttggctctcttgtatctgggcgtgaagaatattcatcttggacctacgcttccgggattcctttcacccaatgtggcaaaggttctggtggagaagtttggcatcgcaggtattggcactgttgaagatgatatcaaattgtttatgtcttaa

SEQ ID NO: 1720 - protein, 542 aa, Clostridium thermocellum ATCC 27405
MSMFCYQCQETAGGKGCTVRGVCGKNEEVAKLQDLLLYTVKGISYIVTKGNIDAAKLGNTNHEVLSSLFMTITNVNFDDGSIEKQIRKMLAVRDEMKKSVQAEGLHDAAVFSVDSRESMLKKADSVGVLSTQNEDIRSLREMITYGVKGMAAYAEHAKNIGKEDKEIYSFIYEALAATLDDSLSVDDLFALTLKTGEYGVKVMALLDEANTSRFGNPEITEVNIGVRKNPAILVSGHDLTDLEQLLEQTKGTGVDVYTHGEMLPAHYYPAFKKYDNFVGNYGNAWWKQVEEFESFHGPILFTTNCIVPPRSEEVRRRIFTTGSAGFPGCKHIEADENGKKDFSEIIELAKTLPAPDEIETGSIVGGFAHNQVMALADKVVEAVKSGAVKKFFVMAGCDGRMKSRSYYTEFAQNLPKDTVILTAGCAKYRYNKLGLGDIGGIPRVLDAGQCNDSYSLAVIALKLKEVFGLDDINKLPIAFNIAWYEQKAVIVLLALLYLGVKNIHLGPTLPGFLSPNVAKVLVEKFGIAGIGTVEDDIKLFMS

SEQ ID NO: 1721 - DNA, 1620 bp, Desulfovibrio vulgaris subsp. vulgaris str. Hildenborough
  CDS (1)..(1620): transl_table=11
atgtccatgttctgcaaccagtgtgaacagaccgccaaaggaaccggctgcaccaccatcggtgtatgcggcaagcagcctgaagtctcggcgcttcaggacctcaccatctacgccttgcgcggtctctccctcgtggccctcgccgcccgcgagaagggcatcatcgatgccaagatagatgaatacacggccaaagccctgttcaccacgctcaccaacgtgaacttcgaccccgcccgcttcgacgtgtacgttcgcgaaatcgtggcgcaccgcaaggcgctggccgcccgcgccggggtggacttcagtgagggtcccgccgcattcgagcctgcctccaccctcgacgggctggtggcacaggctgaaatcggttcggtcaccgccggggcggaagatgccgacatccgctcgctcaagcagattctgctctacggcatgaagggcgtcgcggcctatgtcgaccatgccgccatcctcggccagaccgacgcagccgtcttcggcttcctgcacaagggccttgccgccggatacgatggcgtcgcccgagaccttggcgcatggatcgaactggccatggaatgcggtcgcgccaacctgcgggccatggaactgcttgacgcgggcaacaccacaacctacgggcaccccgttcccacgcaggttcccctggggcaccgcaagggcaagtgcatcctcgtctcgggacacgacctcaaggaccttttcgaactgctgaagcagaccgagggcaagggcatcgacatctacacccacggcgagatgctgcccacccacgcctaccccgaactgaagaagttcccccacttctacggtcacttcggcacggcatggcagaaccagcacaaggaattcccggccttccccggtgccatcctcttcaccaccaactgcatccagaagccgcaggcgtcctacgccgccaatgtcttcaccaccggactcgtgggctggcccggactcgtccactgcgagaaccacgacttcacgccggtcatcaacaaggcgcttgaactgcccggtttcaccgacgacgtacccggcaagaccgtcaccgtgggcttcggacgcaacaccgtcatgagcgtggcccccgccgtcatcgacgcggtcaagtccggtgccatccgccacttcttcctcgtgggcggttgcgacggcgcgaagcccggccgcaactactacaccgaattcgttgagaagacgcccgccgacaccgtggtgctgacgctggcatgcggcaagttccgcttcttcgacaaggacctcggcaccatcggcggcattccccgtctgctcgacgtgggtcagtgcaacgacgcatactccgccatcaagatcgcatcggcgcttgccgaagccttcaactgcggcgtcaacgacctgcccctctcgctggtgctctcgtggtacgaacagaaggccgtggccatcctgctcaccctgctggcgataggtatcaaggacatccgcctcggcccgtcactgcccgccttcgtgacgccgaacgtgctcaagttccttgtggacaacttcaacatcaagcccatatccacagccgacgaagacctgaaggccattctgggctaa

SEQ ID NO: 1722 - protein, 539 aa, Desulfovibrio vulgaris subsp. vulgaris str. Hildenborough
MSMFCNQCEQTAKGTGCTTIGVCGKQPEVSALQDLTIYALRGLSLVALAAREKGIIDAKIDEYTAKALFTTLTNVNFDPARFDVYVREIVAHRKALAARAGVDFSEGPAAFEPASTLDGLVAQAEIGSVTAGAEDADIRSLKQILLYGMKGVAAYVDHAAILGQTDAAVFGFLHKGLAAGYDGVARDLGAWIELAMECGRANLRAMELLDAGNTTTYGHPVPTQVPLGHRKGKCILVSGHDLKDLFELLKQTEGKGIDIYTHGEMLPTHAYPELKKFPHFYGHFGTAWQNQHKEFPAFPGAILFTTNCIQKPQASYAANVFTTGLVGWPGLVHCENHDFTPVINKALELPGFTDDVPGKTVTVGFGRNTVMSVAPAVIDAVKSGAIRHFFLVGGCDGAKPGRNYYTEFVEKTPADTVVLTLACGKFRFFDKDLGTIGGIPRLLDVGQCNDAYSAIKIASALAEAFNCGVNDLPLSLVLSWYEQKAVAILLTLLAIGIKDIRLGPSLPAFVTPNVLKFLVDNFNIKPISTADEDLKAILG

SEQ ID NO: 1723 - DNA, 1653 bp, Erwinia carotovora subsp. atroseptica SCRI1043
  CDS (1)..(1653): transl_table=11
atgttttgtgtgcaatgtgaacaaacgattcgtacccctgttggaaacggctgctcttacgcgcagggcatgtgcggcaaaaccgcagaaacctccgatctgcaagacctgctggtggctgtgctgcaagggctttctgcctgggcgctgaaagcacgcgaactggatattatcgatcatgatgtcgataactttgcaccacgcgctttcttctctacgttgaccaacgttaacttcgattcccaacgtattattggctacgcacaggaagccattacactgcgtgagtcgctagcagttcgctgccgtctgcacgatgccacggcgaccgtagatcacccgatggcagcgctgcaactggcaggcaacgatattccgaccttactgcaacaggcagaggattttgcgctggacagcgataaagccatcgtgggtgatgacgtccacggcttgcgtatgctcaacctctacggcctgaaaggcgcagcggcctacatggaacacgcccatgttcttggtcaatatgacaacgctatctatgccgaatatcatgctttcatggcatggctgggcacacagccaaccgacgtcgataccttgctgaacaacgcaatgggcatcggtaaaatgaactttaacgtcatggcaatcctcgatcatggcgaaaccgacgcttacggtcacccacagccaacctccgttaacgtacgcccgattgcgggtaaagccattctgatttcaggtcatgacctgaaagacctgcgcatgctgctagagcaaaccgaaggcactggcgtgaatatttatacgcacggcgagatgctgcctgcacatggttacccagagctgaaaaaattcaagcatctggcaggtaactacggcagcggctggcaaaaccaacaaaccgagtttgccaaattccctggcgcgatcgtcatgacgtctaactgtattatcgacccgaacgtgggcaactacggcgatcgcatctggacgcgcagcatcgtaggctggccgggcgtgaaccatctggaaggtgacgatttcagttcggttatcgaacaggcacaaggtctggcgggtttcccatacagcgaaatcgagcacatgatcaccgtcggctttggtcgtgaaacgttgctgagcgccgcagataccgtcatcgacctggttgcacagaaaaaactgcgccacgtctttctggttggcggatgtgacggcagccgtgaagaacgcagctacttcactgacttcacgctgagcgtcccgcaggattgcctgatcatgacgctggcatgcggtaaataccgcttcaacaaactggatttcggtacgctggaaggcctgccacgtctgctggatgttggtcaatgtaacgacgcctatgcggcaattattctggccgttaaattggcggaaaaactgggctgtggcgtcaacgatctgccgcttagtctggtgctgtcttggtttgaacagaaagcgattgtcatcctgcttaccctgctgtctcttggcgtgaaaaatatttacaccgggccaactgcaccgggcttcctgacggacaacctgcttgccattctgaacgacaaattcggtatgcgggcgattaccaccgttgaacaggacatgaacaccattctggccgcttga

SEQ ID NO: 1724 - protein, 550 aa, Erwinia carotovora subsp. atroseptica SCRI1043
MFCVQCEQTIRTPVGNGCSYAQGMCGKTAETSDLQDLLVAVLQGLSAWALKARELDIIDHDVDNFAPRAFFSTLTNVNFDSQRIIGYAQEAITLRESLAVRCRLHDATATVDHPMAALQLAGNDIPTLLQQAEDFALDSDKAIVGDDVHGLRMLNLYGLKGAAAYMEHAHVLGQYDNAIYAEYHAFMAWLGTQPTDVDTLLNNAMGIGKMNFNVMAILDHGETDAYGHPQPTSVNVRPIAGKAILISGHDLKDLRMLLEQTEGTGVNIYTHGEMLPAHGYPELKKFKHLAGNYGSGWQNQQTEFAKFPGAIVMTSNCIIDPNVGNYGDRIWTRSIVGWPGVNHLEGDDFSSVIEQAQGLAGFPYSEIEHMITVGFGRETLLSAADTVIDLVAQKKLRHVFLVGGCDGSREERSYFTDFTLSVPQDCLIMTLACGKYRFNKLDFGTLEGLPRLLDVGQCNDAYAAIILAVKLAEKLGCGVNDLPLSLVLSWFEQKAIVILLTLLSLGVKNIYTGPTAPGFLTDNLLAILNDKFGMRAITTVEQDMNTILAA

SEQ ID NO: 1725 - DNA, 1638 bp, Desulfotalea psychrophila LSv54
  CDS (1)..(1638): transl_table=11
atgctctgtaatcaatgtgaacaaacagcaaaaggcaccggatgtacccaaattggtgtttgcggcaagacagacgaagtggcagcactccaggatctacttacctatagcctccaaggcctctccatcgtcatccaggaggcacgaagaaaagacctcgtttccaccgaggttaagcactttatcactaagagtgtttttgcctgcctgacaaatgttgattttgaccccatccgttttcaacagtggatcaatgctagcgtcaacatccgcaaagaccttctccggcaacttggtaaggacatcgcaaaaagattggaaggaacacacccgagtgtctcctttgccccggcactggagctcacagcccttatccagcagggtcaggaacttgacctgatcgccagccttgacgagaatgaagatctccgctccctcaaacagaccatcctctatggcctgcggggacttgccgcctataccgaccatgctgctattttaggtaaagaagacaatacggtctatatctttatcttcgataccttggccacaattacccgcaatgacctctcccttgaagagcttgtcgatctcacccttgagtgtggccaagtaaacctgaccgccatggggctgcttgatgagggcaacacaggaacctatggtcaccctgtccccaccaccgttcctcttggccacatagcgggcaaggcaatcctggttaccggtcatgacctcaaggatctgcagctcctccttgaacaaaccgagggcaagggcatcaatatctatacccacggcgaaatgcttccctgccatggttatccggaactgaaaaaatatagccatttttatggtcactacggcacggcttggcagaatcagcaaaaagagatggctctctttccaggtgccatcctctttaccaccaactgcatccaaaaaccccgtgacaactataaggacaatgtcttcaccacaggtcttgtcggctggccggatgttgcccatatcgatgacggcaaaaattttagccccgttattgaacgtgccctcgcacttcccggttttactgaagaagaggacaatgatacagtaatggttggctttggccataacgcagtaatgggcgttgccgataagattattgccggagttaaggctggcaagattcgccacttcttcctggtcggcggctgtgatggtgctaaacccggtcgtaattactacactgattttgttgagcaggtgccggaagattgcatcgtcatgaccctggcctgtggtaagttccgcttctttgataaaaaactcggtgatattgacggaattccccgtctccttgacattggtcagtgtaacgatgccttctctgcaatccaaattgcggtagcacttgcaggggcctttaaatgtgatgtcaatgaactgccactctccatgattctttcctggtatgagcagaaggctgtcattattctcctcaccctgctgagcctggggatcaccgacatccgtcttggacccaccctgcccgcatttctcaccccaaatgtcctcaacttgctggtagagaaatttgccatcaagcccattgccgagaccgcagcagaagacctgaaaaccatacttggctaa

SEQ ID NO: 1726 - protein, 545 aa, Desulfotalea psychrophila LSv54
MLCNQCEQTAKGTGCTQIGVCGKTDEVAALQDLLTYSLQGLSIVIQEARRKDLVSTEVKHFITKSVFACLTNVDFDPIRFQQWINASVNIRKDLLRQLGKDIAKRLEGTHPSVSFAPALELTALIQQGQELDLIASLDENEDLRSLKQTILYGLRGLAAYTDHAAILGKEDNTVYIFIFDTLATITRNDLSLEELVDLTLECGQVNLTAMGLLDEGNTGTYGHPVPTTVPLGHIAGKAILVTGHDLKDLQLLLEQTEGKGINIYTHGEMLPCHGYPELKKYSHFYGHYGTAWQNQQKEMALFPGAILFTTNCIQKPRDNYKDNVFTTGLVGWPDVAHIDDGKNFSPVIERALALPGFTEEEDNDTVMVGFGHNAVMGVADKIIAGVKAGKIRHFFLVGGCDGAKPGRNYYTDFVEQVPEDCIVMTLACGKFRFFDKKLGDIDGIPRLLDIGQCNDAFSAIQIAVALAGAFKCDVNELPLSMILSWYEQKAVIILLTLLSLGITDIRLGPTLPAFLTPNVLNLLVEKFAIKPIAETAAEDLKTILG

SEQ ID NO: 1727 - DNA, 1716 bp, Desulfotalea psychrophila LSv54
  CDS (1)..(1716): transl_table=11
atgttctgttttcaatgtcaagaaaccgctaaaggtacaggatgcacagtcaagggtgtttgtggaaaacaagagacaacggccaaccttcaggatctgctcatctacgatctcaagggtattgccgtcttggcaaagggcctcaaaaatgcaggtgtaaaggttgataaaagcgtcggattattcatctctcaggggctttttaccaccatcaccaatgccaactttgacaacgccagcctggagggatggatcaagcgctcccaggccattaagcagggtctaaaaacagagttagatggtcttggctctgctagcgagcaggcctctatctggaagacacttatgaacttcctcggctccgacgacaaggcattagcatcagaccagctggacggttctgccctatggtttgccagcgatcctgccatgtttcaagagaaggccaagaccgtcggagtgctggccacagaaaacgaagatgtcagatctctacgcgaactgcttattcttggcctaaagggtattggtgcctatgccgagcatgcggccgtgctcggggtggaaaaagaagagatctatgactttgtcattgaaggcatggcctccaccacggaagatcattccgttgatgaaatggtaagccttgtcctcagggccggcgaatgcgctgtcaccaccatggcagcactggatacagccaataccacgagctatggtcatcctgagataagcgaggtaaacatcgggggcagtgacaaggcagccattctgatcagtggacatgatcttaaagatctcgaggagttaatgatccagacccagggaacggggattgatgtttacacccatggcgagatgcttcccgcccattactatcccacattcaagaaatacgaaaaccttaagggcaactatggtagctcatggtggcatcaaaataaggatttcgagagcttcaacggcccgatcctaatgaccaccaactgtatcgtacccatcagggagagcaactcttacaaaaaccgcatctacaccaccggtatggccggttatccgggagtatctcatattgccgacagggtaatgggcaaggcaaaggatttttccgccattatcaaacaggccaagggctgcagtgcacctgaggaaattgaaacaggcaccatcgttggcggctttgcccataatcaggtaatagccctggccgacaaggtggttgaagcggtaaaatccggggctatcaaaagatttgtggtcatggcaggctgtgatggccgccaaaagggacgcggctacttcaccgaagttgctgagaaacttcctaaggacacggtcattctcaccgccggttgcgcaaagtatcgctacaacaagctgaacctcggtgatatcggcggcatcccgcgggtactcgatgccggtcaatgcaatgactcctactccctggcagttatcgccctcaaacttaaggaagtgttccagctcgaagatatcaacgagctccccatctcctttgatatcggctggtacgagcagaaggcggtggcagtactcctggccctcctgcatttgggagttaagggtatccgtctcggaccgagcctgcccgcctttatttcgccagcggtactcaaggtgctggtagataacttcaacatcaagcccatcggcaccgccgagagtgatattgctgacatgatggccggcaactag

SEQ ID NO: 1728 - protein, 571 aa, Desulfotalea psychrophila LSv54
MFCFQCQETAKGTGCTVKGVCGKQETTANLQDLLIYDLKGIAVLAKGLKNAGVKVDKSVGLFISQGLFTTITNANFDNASLEGWIKRSQAIKQGLKTELDGLGSASEQASIWKTLMNFLGSDDKALASDQLDGSALWFASDPAMFQEKAKTVGVLATENEDVRSLRELLILGLKGIGAYAEHAAVLGVEKEEIYDFVIEGMASTTEDHSVDEMVSLVLRAGECAVTTMAALDTANTTSYGHPEISEVNIGGSDKAAILISGHDLKDLEELMIQTQGTGIDVYTHGEMLPAHYYPTFKKYENLKGNYGSSWWHQNKDFESFNGPILMTTNCIVPIRESNSYKNRIYTTGMAGYPGVSHIADRVMGKAKDFSAIIKQAKGCSAPEEIETGTIVGGFAHNQVIALADKVVEAVKSGAIKRFVVMAGCDGRQKGRGYFTEVAEKLPKDTVILTAGCAKYRYNKLNLGDIGGIPRVLDAGQCNDSYSLAVIALKLKEVFQLEDINELPISFDIGWYEQKAVAVLLALLHLGVKGIRLGPSLPAFISPAVLKVLVDNFNIKPIGTAESDIADMMAGN

SEQ ID NO: 1729 - DNA, 1710 bp, Desulfotalea psychrophila LSv54
  CDS (1)..(1710): transl_table=11
ttgtcctggggattctcaggaaatgaaattaagggggtatctatgttttgccatcagtgtcaggaaacagctaagggaacgggctgcaccgttcaaggtgtttgtggtaaaagagaagaggttgctaatcttcaagatctttttatttggacccttaagggtatttctgtctggggtcttaagggcaaggaatttgctatttacgatgagaaggtcgccttttttatcgtcaagggtatgttcgccaccataacaaatgcaaattttaacggtgctgatttcatcggttttatcaaagaggctgtggtccatcgtcagcatctgcaggcgcaggtgcttcaggctcatctcttggcccatggaacagcctttgttgaagacctgcccgaatgtgccacttggtcctttggggatgaaactgatattctggccaaggcttcaagagggacaggaggttggctagaaatagtggatgaggatgaacgttctcttaaggccactgttttgtacggtttgaaggggctctgtgcctatgcggaacacgcctatcagttgggtggtcatagtcgggagatctttgaatttctgatggaagctcttgcggccctggttgattctacccagacccttgaagaactcctggctttggttcttaaaacaggggggatgggggtacagaccatggccctgcttgatcaggtaaataatgagagctatggcgccactgaaataagcacagttagtctgggggttggcgataagccgggtattttggtcagtggccatgaccttaaggatctggaagagctgttggtccaaaccgagggtaagggggttgatatctatacccacagtgaaatgcttccggcccattattatcccaaacttaaaaaatatgatcatctcgttggtaattatggtaactcctggtggctacagaagagggagtttgactcctttcacgggccggtcctctttacctcaaactgtattgttcctcctaaacccgaacatgttgatcgaatttttaccaccggtgccgtaggggttgtcggttgtgcccatattcccgatcgcagtgggggcgaggctaaggacttttcccagattatcgatctcgccctatcctctcaaccacctgagcagattgaaactggtaccatcgttggtggctttggtcataaccaggtgctggccttaaaagacaaaattattgatgcggtaaaatcgggggccatcaaaagattcgtggtcatgggaggatgtgacggccgtcataaaagccgtaactactataccgaggtggccagattgctacctaaggatacgattattcttactgccggctgtgctaagtataagtatcttaagcttgatcttggtgatatcggtggtattcctcgggtgcttgatgccggtcagtgtaatgattcctactctctggcagtgatcgcccttgagttacaaaaggcctttgcccttgaaaatattaacgatctgcccatctcctatgatattgcctggtatgagcagaaggccgttttggttcttcttgccctgctctctctggggataaagggtatccgtcttggcccaaccctgccgggttttttctcagaaaatattgccagtatcttgacggaacattttgagattaaggccattggaactccggaagaggatgtcgcggcgatgatggcggggcattaa

SEQ ID NO: 1730 - protein, 569 aa, Desulfotalea psychrophila LSv54
MSWGFSGNEIKGVSMFCHQCQETAKGTGCTVQGVCGKREEVANLQDLFIWTLKGISVWGLKGKEFAIYDEKVAFFIVKGMFATITNANFNGADFIGFIKEAVVHRQHLQAQVLQAHLLAHGTAFVEDLPECATWSFGDETDILAKASRGTGGWLEIVDEDERSLKATVLYGLKGLCAYAEHAYQLGGHSREIFEFLMEALAALVDSTQTLEELLALVLKTGGMGVQTMALLDQVNNESYGATEISTVSLGVGDKPGILVSGHDLKDLEELLVQTEGKGVDIYTHSEMLPAHYYPKLKKYDHLVGNYGNSWWLQKREFDSFHGPVLFTSNCIVPPKPEHVDRIFTTGAVGVVGCAHIPDRSGGEAKDFSQIIDLALSSQPPEQIETGTIVGGFGHNQVLALKDKIIDAVKSGAIKRFVVMGGCDGRHKSRNYYTEVARLLPKDTIILTAGCAKYKYLKLDLGDIGGIPRVLDAGQCNDSYSLAVIALELQKAFALENINDLPISYDIAWYEQKAVLVLLALLSLGIKGIRLGPTLPGFFSENIASILTEHFEIKAIGTPEEDVAAMMAGH

SEQ ID NO: 1731 - DNA, 1653 bp, Yersinia pseudotuberculosis IP 32953
  CDS (1)..(1653): transl_table=11
atgttctgtgtgcaatgtgaacaaactatccgaacgccagcaggtaacggctgctcttacgcgcagggaatgtgtggaaaaaccgccgaaacctcagatctacaagacttgctggttgctgtattacaggggctatcggcttgggcgttacaagcccgtgaactgggtattatcgatagccaaattgacagctttgcccccagagcatttttctcaacgctgaccaacgtgaatttcgattccgaccgtattgtggaatacgccaaagacgccattttactgcgccactctctggctgtccgttgccgcctgttggatagcacaattaccgttgatcacccactggctgagttgcaactggtggcagacgatatcccttctctgctgcaacaatcacagcagttcgccctcaataacgataaagcggatgtgggcgatgatattcacggcctgcgtatgctgtgcttatacggcttgaaaggcgcggcggcttatatggaacacgcccatgtattaggccagtctgatgaacaaatttatgcggagtaccatgcctatatggcctggttgggtacccagccccgtgatgtcgataccttactgaataacgccatgggtattggtaaaatgaacttcaatgtgatggccattttagatcagggcgaaacccaggcctatggcgatccacaaccgacgtccgttaatgtccgcccggtagcaggcaaagcgattttaatttccggccatgacctgaaagatttacacatgttgctggagcagacgcagggcacaggcattaatatttacactcacggtgaaatgttgcccgctcacggctatccggagttaaaacgttatccacatttggtggggaactacggcagcggctggcagaatcagcagaccgaattcgccaagttccctgggccgatcctgatgacttccaactgtattattgatccgaatgtgggcaactacggtgaccgcatctggactcgcagcatcgttggctggccaggtgtcaaccacttagacggggagaatttcgccccggtgattgagcaagcgctcggaatggcgggcttcccctacagtgaactggaacacctgattactgtcggttttggccgccagacactcctaaatgccgctgataccgttattgatttggttgccagtaaaaagctacgccatgtcttcttggtagggggatgtgatggtagccgtactgagcgcagttatttcaccgatttcgcccgcagtgtgccgcaagattgcatcattatgacgctagcctgtggcaaataccgcttcaataaactggacttcggcactctggaaggattaccgcgcttactggacgtcggccaatgtaatgacgcatacgccgctatcatgttggcggttaaattgtcggaaaaattgggttgcaccgtcaatgacctgcctctcagtttggtgctgtcatggtttgagcaaaaagccattgtcattctgctcacgctattgtcgctgggtgtgaagaatatttacaccggcccaacggcaccaggtttcctgaccgacaacctgatggcgatcctttatgagaaatttggtatgcagccaataaccaccgtagaacaggatatgcaggcgattttgggccattaa

SEQ ID NO: 1732 - protein, 550 aa, Yersinia pseudotuberculosis IP 32953
MFCVQCEQTIRTPAGNGCSYAQGMCGKTAETSDLQDLLVAVLQGLSAWALQARELGIIDSQIDSFAPRAFFSTLTNVNFDSDRIVEYAKDAILLRHSLAVRCRLLDSTITVDHPLAELQLVADDIPSLLQQSQQFALNNDKADVGDDIHGLRMLCLYGLKGAAAYMEHAHVLGQSDEQIYAEYHAYMAWLGTQPRDVDTLLNNAMGIGKMNFNVMAILDQGETQAYGDPQPTSVNVRPVAGKAILISGHDLKDLHMLLEQTQGTGINIYTHGEMLPAHGYPELKRYPHLVGNYGSGWQNQQTEFAKFPGPILMTSNCIIDPNVGNYGDRIWTRSIVGWPGVNHLDGENFAPVIEQALGMAGFPYSELEHLITVGFGRQTLLNAADTVIDLVASKKLRHVFLVGGCDGSRTERSYFTDFARSVPQDCIIMTLACGKYRFNKLDFGTLEGLPRLLDVGQCNDAYAAIMLAVKLSEKLGCTVNDLPLSLVLSWFEQKAIVILLTLLSLGVKNIYTGPTAPGFLTDNLMAILYEKFGMQPITTVEQDMQAILGH

SEQ ID NO: 1733 - DNA, 1662 bp, Mannheimia succiniciproducens MBEL55E
  CDS (1)..(1662): transl_table=11
atgtactgcgttcaatgcgaacaaaccatggtgacgccgaaaggcaacggctgcagcttctctcagggaatgtgcggtaaaaccgccgaaacttcggacttacaggatttacttatcgccacattgcacagcttatccgcatgggcgttaaaagcccgtgagcacaatatcattattcatgaagcggacgcctttgcgccgcgcgcattcttcgccaccctaaccaatgtaaacttcgattccgcgcgtatcgccggctatgcgcaacaagcgttaatttatcgtaaccaattaatcaaagcggtcaatgaagtcgaacccaatccgaatatcgatcacccgttggcgaatatcgaactaaacggcatttccgttgaacaattggctctgcaggcaaaacaattcgcgttggatacggatcgtcaacaaatcggtgaagaagcccacggcgtacgtttgctttgtttatacggtttaaaaggcgccgcggcttatatggaacacgcctatgtgctggataaattcgataacgatatttatgcggaatatcacggtttcatgtcctggctaggcacgcaacccggcgatctgaacgaattactggaaaaagcgctggctatcggcagcatgaactttaaagtgatggccatgctggatgcgggtgaaaccgagcatttcggtaacccggtgcctgcgatggttaacgttcgaccggtaaaaggcaaatgtatcttaatttccggccatgatttgaaagatttaaaagaattattggagcaaacggaaggcaaaggcatcaatgtgtacacccacggtgaaatgctgcccgctcacggttatccggaattgaagaaatacaaacacttggtgggcaacttcggctctggctggcagaatcagcaaaaagaattcgcccgtttcccgggtgccattgtgatgacgtcaaattgtttaatcgacccgaatgtaggcgattacgcagatcgcattttcacccgtaatattgtgggctggccgggtgtaacccatcttgaagatcatgatttctcaccggtgattgaaaaagcattgcaatgcgacggttttccgtatacggaattagaacatttaatcaccgtaggtttcggccgcaaaaccttaatcgacgcctccgatgcggtcattgatttggtcaaagcgggcaaattaagtcatgtattcgttatcggcggttgtgacggcgataaagaagaacgtcattattacaccgatttagcttacgcattaccgaaagataccgccgtattaaccctgggttgcggtaaataccgtttcaataagctggatttcggcaccatcgacggcggtctgccgcggttactggatgcggggcaatgtaacgatacttattccgccatcatgttagcggtgacgctttcacaaaaattaggtatcggcttaaacgaattgccgttatccatcgtgctttcctggtttgaacaaaaagccattatcgtgttattaacgctattagccttgggtgtgaaaaatgtgtattccggtccgagtaaaccggcgttcttaaacgacaatgtgatggcgttattacacgagaaattcggtttaagcggtttaaccacccccgaacaggatttcggccacattatcaataaaaatctataa

SEQ ID NO: 1734 - protein, 553 aa, Mannheimia succiniciproducens MBEL55E
MYCVQCEQTMVTPKGNGCSFSQGMCGKTAETSDLQDLLIATLHSLSAWALKAREHNIIIHEADAFAPRAFFATLTNVNFDSARIAGYAQQALIYRNQLIKAVNEVEPNPNIDHPLANIELNGISVEQLALQAKQFALDTDRQQIGEEAHGVRLLCLYGLKGAAAYMEHAYVLDKFDNDIYAEYHGFMSWLGTQPGDLNELLEKALAIGSMNFKVMAMLDAGETEHFGNPVPAMVNVRPVKGKCILISGHDLKDLKELLEQTEGKGINVYTHGEMLPAHGYPELKKYKHLVGNFGSGWQNQQKEFARFPGAIVMTSNCLIDPNVGDYADRIFTRNIVGWPGVTHLEDHDFSPVIEKALQCDGFPYTELEHLITVGFGRKTLIDASDAVIDLVKAGKLSHVFVIGGCDGDKEERHYYTDLAYALPKDTAVLTLGCGKYRFNKLDFGTIDGGLPRLLDAGQCNDTYSAIMLAVTLSQKLGIGLNELPLSIVLSWFEQKAIIVLLTLLALGVKNVYSGPSKPAFLNDNVMALLHEKFGLSGLTTPEQDFGHIINKNL

SEQ ID NO: 1735 - DNA, 1632 bp, Bacteroides fragilis NCTC 9343
  CDS (1)..(1632): transl_table=11
atgagtatgttctgttttcagtgtcaggaaaccgcaaaaggtacaggttgtatcttaagcggagtatgcgggaaaactcccgaagtagccaatatgcaagacttgctgctttttgtagtacgcggaatcgcagtctacaatcaggcgttacgcaaagatggacgttcttctgcccgggcagataagtttatctttgacgcattgttcactaccattacaaatgccaactttgataaacacgccattatcaagaaaataaagaaaggactggagctaaagaaagatctaagtaaccaagtcacaatagaacatgcgcccgacgaatgtacttggtatggtgacgaaacagagtttgaagagaaagcccaaacggtgggggtgctgcgaacttctgacgaagacattcgatcattgaaggagttggttcactatggtatcaaaggaatggctgcttatgtggagcatgcctataatttaggatatgagaatccggagatatttgcattcatgcaatatgctttggctgaattgacccgcgaagatattactgtggacgaactgataaccctcacactcgctacgggtaaccatggtgtgcaggctatggcccaactcgatactgccaataccagccattacggaaatccggaaatctccgaagtaaacattggtgttcgaaacaatccgggtatccttgtcagtggacatgacttgaaagatattgaagaacttttgcaacagactgaaggtaccggtatcgacatatacacacacagtgaaatgctaccggctcattattatcctcagttgaagaaatataaacacctggtaggaaactacggtaatgcctggtggaaacagaaagaggaatttgaaagtttcaacggtcctattctcttcactactaattgcattgttccaccacgcccgaatgcgacttataaagatcgcatctatacgacaggcgcaaccggcttggaaggtgctacctacatacccgaacgaaaagacggaaagcagaaagatttctccgttattattgagcatgcacggcgttgccaaccaccagtggcaatagaaagtggtaagattgtaggtggatttgctcatgcgcaagtaatcgcactggccgataaggtggttgaagcagtaaaaagcggtgctatccgtaaattttttgttatggccggatgtgacgggcgaatgaaaagtcgcagttactacacagagtttgcagaaaagctaccggcagatacggtaatcctgacagcagggtgcgccaaataccgatataataaattacctctgggggatattaatggcattcctcgtgtactggatgcaggacagtgtaatgacagttactcattggctataattgctatgaagttgcaggaagtcttcggactaaaagacatcaatgatcttccgattgtatataacattgcgtggtacgaacaaaaagccgttattgttctgctggctctgttggcacttggagtgaaaaagattcatttagggccgacgcttcctgcattcttatctcctaacgtgaagcaggtactgatcgataattttggaattggcggtatcagtacagcagacgaagatattgcaaaatttttagcatga

SEQ ID NO: 1736 - protein, 543 aa, Bacteroides fragilis NCTC 9343
MSMFCFQCQETAKGTGCILSGVCGKTPEVANMQDLLLFVVRGIAVYNQALRKDGRSSARADKFIFDALFTTITNANFDKHAIIKKIKKGLELKKDLSNQVTIEHAPDECTWYGDETEFEEKAQTVGVLRTSDEDIRSLKELVHYGIKGMAAYVEHAYNLGYENPEIFAFMQYALAELTREDITVDELITLTLATGNHGVQAMAQLDTANTSHYGNPEISEVNIGVRNNPGILVSGHDLKDIEELLQQTEGTGIDIYTHSEMLPAHYYPQLKKYKHLVGNYGNAWWKQKEEFESFNGPILFTTNCIVPPRPNATYKDRIYTTGATGLEGATYIPERKDGKQKDFSVIIEHARRCQPPVAIESGKIVGGFAHAQVIALADKVVEAVKSGAIRKFFVMAGCDGRMKSRSYYTEFAEKLPADTVILTAGCAKYRYNKLPLGDINGIPRVLDAGQCNDSYSLAIIAMKLQEVFGLKDINDLPIVYNIAWYEQKAVIVLLALLALGVKKIHLGPTLPAFLSPNVKQVLIDNFGIGGISTADEDIAKFLA

SEQ ID NO: 1737 - DNA, 1635 bp, Anabaena variabilis ATCC 29413
  CDS (1)..(1635): transl_table=11
atgttctgtaaccagtgtgaacaaactacccgtggcgatgtctgtcatcagtggggagcctgcggtaaaagtccagaagttgatgctttacaagatttactagtccattgtttacgcggactctcccaggtagcgctacaagcaaaatctctaggactggcgactcgtgagacagatgagttcacctgtgagatgctcttctccacactcacaaacgtcaacttttccacatctgattttattagctttgtcaatcgcgcgatcgccttacgtgaaagtctgaagttacaaattcaagccacaggtaacgccgtcatccaatcggcgattaactcttttcaacctgctagcgacacccaaaaacaaattcagcaaggaaaagacctagaatttgaatttatcagccaatctgctaaaaatgtcgatattttctcactcaagctcaccttattatacggactcaagggtgttgctgcttatgccttccatgccttggaactaaaccagcacgatgaaagcttatacatatttttccacgaagttttagcaaatcttgatgcccaagacaagagtttacaagattggcttgatttaaccttaaaagttgggcaaatgaacctgaaagcaatggaattacttgatgctggtaataccgaaacctttggacatcctaccccaacaactgttccccttggtcataccgtaggtaaagccatcctcgtttcaggacatgatttactcgctttaaaagccgtcctcgaacaaacatctggaaccggaatcaaagtatatactcacggcgaactcctccccgcacatggctatccaaagctaaaacagactcatcctcacctttatggacactacggtacagcgtggcaaaatcaaacccatgagtttgaacgctttcctggtgcgatcgttatgacgactaattgtctcatgccgccccatgaaacttacaaagataaggtgtttactttggggcctgtgggttatcctggtttgcaacatatcagcatccacgacatttccctagttatccaaaaagcattagaactcccaggttttaccgaagatagcgaacaaaaaacagtaactacaggttttgctagaaatgcagttttaggtgtagccgatactgtcattaatgcggtaaaacaaggtgatatccgccacttcttcctagttggtggttgtgatggcgcgaaaccaggacgcaattactacagtgatttagtagaaaaaatccccaatgattgtgtagtcttaactttgggttgtggcaaattccgcttctttgatcagaatttgggtgatatcggtgggattcctcgcttactcgacctcggacagtgtaacgatgcttactcagccattcagattgccgtggctttagccaatacttttgaagttaatgtgaatcaactaccactgtcgatgatactgtcttggtatgaacaaaaagcgatcgctgttctcctaacactgttgtacttgggtatccaaaatattcgcattggccccacactcccagctttccttactcccaatgttgtgaagttgctctcagaaaccttccatctccaactcatcaccacaccagaacaagatttggcggtatgtctaggttaa

SEQ ID NO: 1738 - protein, 544 aa, Anabaena variabilis ATCC 29413
MFCNQCEQTTRGDVCHQWGACGKSPEVDALQDLLVHCLRGLSQVALQAKSLGLATRETDEFTCEMLFSTLTNVNFSTSDFISFVNRAIALRESLKLQIQATGNAVIQSAINSFQPASDTQKQIQQGKDLEFEFISQSAKNVDIFSLKLTLLYGLKGVAAYAFHALELNQHDESLYIFFHEVLANLDAQDKSLQDWLDLTLKVGQMNLKAMELLDAGNTETFGHPTPTTVPLGHTVGKAILVSGHDLLALKAVLEQTSGTGIKVYTHGELLPAHGYPKLKQTHPHLYGHYGTAWQNQTHEFERFPGAIVMTTNCLMPPHETYKDKVFTLGPVGYPGLQHISIHDISLVIQKALELPGFTEDSEQKTVTTGFARNAVLGVADTVINAVKQGDIRHFFLVGGCDGAKPGRNYYSDLVEKIPNDCVVLTLGCGKFRFFDQNLGDIGGIPRLLDLGQCNDAYSAIQIAVALANTFEVNVNQLPLSMILSWYEQKAIAVLLTLLYLGIQNIRIGPTLPAFLTPNVVKLLSETFHLQLITTPEQDLAVCLG

SEQ ID NO: 1739 - DNA, 1668 bp, Burkholderia sp. 383
  CDS (1)..(1668): transl_table=11
gtgttttgctatcaatgcgaacagaccgaccggaccggcgcacggcccggctgcgcatcggcgaaaggcaattgcggcaaggatgcaacgacggccgacctgcaggacctgctggtccatgcggtgaagggcattgcgcaatacggcgcgattgcgcgtgcgatgggcgcaccggatcgcgacgccgaccggttcgtgctgtatgcgatgttcacgacgctgaccaacgtgaacttccatgcggcccgtttcgtcgcattgctgcgcgaagcggcgcagatgcgcgaccgcgtgaaggccgcatgtgacgcgagcgcgcgggcggcgggcacggtcgtcccggcgcagcacgggccggcgatgtggcagccggcggacgatctggccggcctgctggaacaggccgcgcgtgtcggcgtggacaacgggctcgacaaggtgggcgcggacatcgtcggcctgcgcgcgctggtgctgtacggtctgaagggcgtgtgtgcgtatgcgcaccatgcgcgggtgctcggctacgagcgcgacgacatctacgaggggatcgaggcggcgctcgcgtttctcgcgcgcgaccccgacgacgtcaacgcgctgctcacgcaggcactcggcctcggccggctgaacctgacggtcatggaactgctcgacagcgcgaacaccggccgtttcggcgcgcagcagccgacggccgtgcgcgtgtcgccggtggcgggcaaggcgatcctcgtgtcgggccacgatctcggcgatctgcacgcgctgctcgaacagacggccggcacgggcattcacgtgtacacgcacggcgagatgctgccggcccatgcgtatccggtgctgaaggcgtttccgcacctggtcggcaactacggcggcgcgtggcaggatcagcaaagcgatttcgcgcatttccccgggccgatcctgatgacgtccaattgcatcatcgagccgatgccgcagtaccggcagcggatcttcacgacggggccggtcggctggccgggcgtgcgccatctcgagcatcacgatttttcgacgctgatccgcgccgcgcaggcgctgcccgggttcccggccacggcggcggaggagacgatcacggtcggcttcggccggcatgcggtgctcggcgtggcggacaaggtcatcgacgcggtcaaggccggacagatccgccatttcttcctgatcggcggctgcgacggcgcggcgccgggccgcaactactacaccgagttcgcggagcaggcgcccgacgatacggtcgtgatgacgctcggctgcaacaagtaccgcttcaaccggcatgcgttcggcgatatcggcggcattccgcgcctgctcgacgtcgggcagtgcaacgacagctattcggcgattcggatcgcgacggcgctcgccgatgcattcgaatgcggcgtgaacgacttgccgctgtcgctcgtgatctcgtggttcgagcaaaaggcggcggccgtgctgctgacgctgctcgcgctcggcctgcgcaacatccgtctcgggccgacgctgccggccttcgtgacgccgggcgtgctggcggtgctggtcgagcaattcggcatccagccgatcggcgacgccggcaccgacctggccgcgtcgctggcgcgccacgcggcttga

SEQ ID NO: 1740 - protein, 555 aa, Burkholderia sp. 383
MFCYQCEQTDRTGARPGCASAKGNCGKDATTADLQDLLVHAVKGIAQYGAIARAMGAPDRDADRFVLYAMFTTLTNVNFHAARFVALLREAAQMRDRVKAACDASARAAGTVVPAQHGPAMWQPADDLAGLLEQAARVGVDNGLDKVGADIVGLRALVLYGLKGVCAYAHHARVLGYERDDIYEGIEAALAFLARDPDDVNALLTQALGLGRLNLTVMELLDSANTGRFGAQQPTAVRVSPVAGKAILVSGHDLGDLHALLEQTAGTGIHVYTHGEMLPAHAYPVLKAFPHLVGNYGGAWQDQQSDFAHFPGPILMTSNCIIEPMPQYRQRIFTTGPVGWPGVRHLEHHDFSTLIRAAQALPGFPATAAEETITVGFGRHAVLGVADKVIDAVKAGQIRHFFLIGGCDGAAPGRNYYTEFAEQAPDDTVVMTLGCNKYRFNRHAFGDIGGIPRLLDVGQCNDSYSAIRIATALADAFECGVNDLPLSLVISWFEQKAAAVLLTLLALGLRNIRLGPTLPAFVTPGVLAVLVEQFGIQPIGDAGTDLAASLARHAA

SEQ ID NO: 1741 - DNA, 1650 bp, Geobacter metallireducens GS-15
  CDS (1)..(1650): transl_table=11
atgggaatgttctgtaaccagtgcgaacaggccgccaagggcgtcggctgcgacatcatcggggtatgcggcaagaaccccgaggtggccgccctgcaggatctcatgctttacgggcttaagggactcgccatttatgccgacaaggcccgggagctgggcgtgaaggaagagaagatcgactacttcgtccttgaggggctcttcaccaccgttaccaacgtggacttcgacccggtccagattgccggcaaactccgcacgtgctacgactacaaggaaaggatcaaggccctctacgaaaccgcctatcgggaaaagaacggttccagcgctccacagatcaccgccggtcccgccgcgtgggtcattgccggcgatctcgaagggctcgtgaagcaggggcaggagcacggcatcaacacccaccacgccgacgccgacatccgctccgccatcgagattctcatctacggcctcaaggggatggccgcctacgccgaccacgcctacatcctcggcaaaaaggacgaagaggtcttcgccttcttccacaaggccatggccgccaccgccgacccggccaaggggctcatggacttcgtggggctcgccatggagtgcggcaagctgaacatcaaggtcatggggatgctgaacgaaggtcacgtggcccattatggccacccggtccccaccaaggttccgaccggcacccgcaagaacaaagggatccttgtctccggccacgacctccgcatgctggaggagctcctgaagcagaccgacgggaaagggatcgacgtttacccccacggtgaaatgctcccggcccacggctatcccggcctcaagaagtacgcgcacctctacggcaacttcggcggcgcatggcaggaccaagcgaaggaattcccccacttccccggcgccatcatcttcaacaccaactgcatccagcgcccggccgactcttacaaggaccgcctcttctcctggggccaggtggggtggcccggtgtgaagcacatcaacggctgggacttctccgaagtcatcaacaaagcccttgagtgccccgagctggccgacgcgccggcgaaggagattctcaccggttttggccacaacgccgtccttggcgtggcggacaaggtgatcgaaggggtgaaggcgggcgccatcaagcacttcttcctcatcggcggctgcgacggcgccaagccgggccgcaactactacaccgagcttgccgagaaggtgccccaggactgcgtgatcctgaccctggcctgtggcaagtaccgcttcaacaagcttgagttcggcgacatcggcggcatcccgcggctcctggacatcggccagtgcaacgacgcttactcggccctccagatcgccctggcccttgccgacgccttcaagtgcggcgtaaacgatctgcccctctccatgatcctctcctggtatgagcagaaggcggtggtcatcctcctgtcgctcctgcacctggggatcaagaacatcaagatcggcccgagcctcccggccttcgtcacccccaacgtcctcaacttcctggtggagaacttcaacctgggtcccatcaccacggtggacgcagacctcaaggcggccctggggcagtaa

SEQ ID NO: 1742 - protein, 549 aa, Geobacter metallireducens GS-15
MGMFCNQCEQAAKGVGCDIIGVCGKNPEVAALQDLMLYGLKGLAIYADKARELGVKEEKIDYFVLEGLFTTVTNVDFDPVQIAGKLRTCYDYKERIKALYETAYREKNGSSAPQITAGPAAWVIAGDLEGLVKQGQEHGINTHHADADIRSAIEILIYGLKGMAAYADHAYILGKKDEEVFAFFHKAMAATADPAKGLMDFVGLAMECGKLNIKVMGMLNEGHVAHYGHPVPTKVPTGTRKNKGILVSGHDLRMLEELLKQTDGKGIDVYPHGEMLPAHGYPGLKKYAHLYGNFGGAWQDQAKEFPHFPGAIIFNTNCIQRPADSYKDRLFSWGQVGWPGVKHINGWDFSEVINKALECPELADAPAKEILTGFGHNAVLGVADKVIEGVKAGAIKHFFLIGGCDGAKPGRNYYTELAEKVPQDCVILTLACGKYRFNKLEFGDIGGIPRLLDIGQCNDAYSALQIALALADAFKCGVNDLPLSMILSWYEQKAVVILLSLLHLGIKNIKIGPSLPAFVTPNVLNFLVENFNLGPITTVDADLKAALGQ

SEQ ID NO: 1743 - DNA, 1728 bp, Desulfovibrio desulfuricans G20
  CDS (1)..(1728): transl_table=11
atggtgtctttaacaacggcagacaacctgccccgctccggcggaaaccagctgaacccggaagaaccggacagaattccggtttatttcgaaaccaagccgaaggagtacagtatgttttgcaaccagtgtgaacagacagccaagggaaccggctgcaccgccatgggcgtgtgcggcaagcaacccgaagtttccgaccttcaggacgccaccgtatacgcgctgcgcggccttgccatagcagcacaggacgctgcagccaaaggcgtgagagaacagggcatgggccattacaccgccgcccgtcttttcagcacgctgaccaacgtgaacttcgaccccgaccgctttgtgccgtgggtgcacgaaataacggccatgcgcgacgaccttgtacgcaaggcaggcctttcctacacctccggaccggcggcatttgttcccggtgccgatgcggcggccatagtgcagcaggctgcggaacacggcaccctgactctggcacctgacgaagacatccgttcgtgcatgcagattctgctctacggtatgaaaggcgtggcagcttacgccgaccatgcagccattctggggcaggaagacaacgcggtgtacgactttctgtacaaaggtcttgccgcgggctttgacggaaaggcccgtgatctgaatgactgggtcgggctgctgcttgaatgcggcaacgtgaacctgcgcaccatggaactgctggacgccggcaacaccggcacctacggtcaccccgtgcccacggaagtgcctctgggacacagaaagggcaaagccatactggtatcaggccatgaccttcgggatctgcatgaactgcttaaacagaccgaaggcaccggcatcaacatttacacccacggtgaaatgctgccctgccacggctaccccgagctgaaaaagttcccccatttctacggacatttcggcaccgcatggcagaaccagcacaaggaattcccgcagttccccggcgccatccttttcaccaccaactgcatccagaaaccgcaggcatcgtatcaggacaatgtcttcaccaccgggctggtgggctggccgggcctgacacactgcgaaaaccgggatttctcggccgtcatcaaacgcgcacaggaactgcccggtttcacggaagacgctcccggcaaaaccgttatgaccggattcggccacaatgcggtgctgggcgtggcaggggcagttgtcgacgcggtgaaaagcggcgccatccgccacttcttccttgtcggcggctgcgacggagccaagcccggccgcaactactacaccgaatttgtggaaaaagcgccggcagacactgtcatcctgacgctcgcctgcggcaaattccgcttctttgacaaagaactcggcaccataggcggcattcccagactgctggacgtgggacagtgcaatgatgcctattccgccattcagatagcagtcgcactggcaaaggctttcgactgcggcgtcaacgacctgcccctttctctggtgctgtcgtggtacgaacagaaagccgtggccatcctgctgacgctgctggcactgggcatcaaggacatccgcctcggcccgtcactgcctgcttttgtcagccccaatgtgctgaacttccttgtcgaaaactacaacatcaagcctatttccacggctgaagaagacctgaaggccattctgggttaa

SEQ ID NO: 1744 - protein, 575 aa, Desulfovibrio desulfuricans G20
MVSLTTADNLPRSGGNQLNPEEPDRIPVYFETKPKEYSMFCNQCEQTAKGTGCTAMGVCGKQPEVSDLQDATVYALRGLAIAAQDAAAKGVREQGMGHYTAARLFSTLTNVNFDPDRFVPWVHEITAMRDDLVRKAGLSYTSGPAAFVPGADAAAIVQQAAEHGTLTLAPDEDIRSCMQILLYGMKGVAAYADHAAILGQEDNAVYDFLYKGLAAGFDGKARDLNDWVGLLLECGNVNLRTMELLDAGNTGTYGHPVPTEVPLGHRKGKAILVSGHDLRDLHELLKQTEGTGINIYTHGEMLPCHGYPELKKFPHFYGHFGTAWQNQHKEFPQFPGAILFTTNCIQKPQASYQDNVFTTGLVGWPGLTHCENRDFSAVIKRAQELPGFTEDAPGKTVMTGFGHNAVLGVAGAVVDAVKSGAIRHFFLVGGCDGAKPGRNYYTEFVEKAPADTVILTLACGKFRFFDKELGTIGGIPRLLDVGQCNDAYSAIQIAVALAKAFDCGVNDLPLSLVLSWYEQKAVAILLTLLALGIKDIRLGPSLPAFVSPNVLNFLVENYNIKPISTAEEDLKAILG

SEQ ID NO: 1745 - DNA, 1650 bp, Rhodospirillum rubrum ATCC 11170
  CDS (1)..(1650): transl_table=11
atgtattgctaccaatgtgaacagacggcccagggtgtggcctgtgtcaccgtcggcctctgtggcaagacggccgaggtcgccgccctgcaggatctgctgatcgaggcggccaagggcctgtcgcaatatgcctaccgcctgcgccagctggggatcgctctgcccgagatcgacgccttcgtgctcgatgcgctgttcaccaccgtcaccaatgtcagcttcgatccggcccggctggaggagcaactgcgcgaggccgcctgtttgcgcgatcagctccgggcccgctacgatgcagcctgcgccgcccgtcacacatctcccgaaaccctgagcggccccgccctgtggcagccggcctcgacgcgggccggtttggtcggcactggcgaggcggcgtcgatcgcccatcgcctgacggcgcaaggcgccgatctgaccggcttgcaggacctgttgctctatggggtgaagggcatggccgcctatgcctgccacgcccgtatcctggggcagaccgacgagagcgtggcggccttcgttcacgaggtgttgaccaccctggccgaggttcccgccgatgccgaggccctgcttgggctggtgctgcgctgtggcacggtgtcgctgacggtgcttgatctgcttgatcgggccaatacgggcgcctatggcgatccgcagccgacgccggttctgatgggccatcgcgccggcaaggcgatcttggtctcgggccatgacctcaaggatcttgccgttcttctcgagcaaaccgtcggtctgggggtcgatatctatacccacggcgagatgctgccggcgcatggctatcccgaactgaagaagtatccccatctggtcggccattacggcggggcttggcagcgccagcgcagcgagttcgccgccttccccgggccgatcctgatgaccaccaactgcatccagaacccgacggcggcctatcgggatcggctgttcacctgtgggctggtcgcccatccggaggcgacggcgctgtcggggcggaatttcgcgccgctgatcgccagcgccctggccgcgcccggctttgccgaggatggcccggtccgtcaccatttggccggcttcggtcacaaggcggtgctgggcgtcgccccgcagatcatcgacgcggtcaaggccggcgccatccgccgcttcgtgctgatcggcggctgcgacggccatgaatccgcccggtcctatttcgacgatctcgccggctcgctgccccaggacgcggtggtgttgacgctgggctgcggcaagttccgggtgatcgatcacgatatgggcaccatcgccggcctgccgcgcctgctcgatatgggccagtgcaacgacgcctattcggcgatcaaggttgcccaggccctggccgaggcctttggcgtcggcgtcaacgacctgccgctgtcgctggtgctgtcatggttcgagcagaaggcggtcaccgtgctgctggcgctgctcgcccttggggtgaggaacattcgcctggggccgaacctgccggctttcatcaccccgccggtgctcaaggtgctggtcgatcgcttcggcatcatgcccgtcggcacggttgccgaggatctggcggcgatggggttggccgcctaa

SEQ ID NO: 1746 - protein, 549 aa, Rhodospirillum rubrum ATCC 11170
MYCYQCEQTAQGVACVTVGLCGKTAEVAALQDLLIEAAKGLSQYAYRLRQLGIALPEIDAFVLDALFTTVTNVSFDPARLEEQLREAACLRDQLRARYDAACAARHTSPETLSGPALWQPASTRAGLVGTGEAASIAHRLTAQGADLTGLQDLLLYGVKGMAAYACHARILGQTDESVAAFVHEVLTTLAEVPADAEALLGLVLRCGTVSLTVLDLLDRANTGAYGDPQPTPVLMGHRAGKAILVSGHDLKDLAVLLEQTVGLGVDIYTHGEMLPAHGYPELKKYPHLVGHYGGAWQRQRSEFAAFPGPILMTTNCIQNPTAAYRDRLFTCGLVAHPEATALSGRNFAPLIASALAAPGFAEDGPVRHHLAGFGHKAVLGVAPQIIDAVKAGAIRRFVLIGGCDGHESARSYFDDLAGSLPQDAVVLTLGCGKFRVIDHDMGTIAGLPRLLDMGQCNDAYSAIKVAQALAEAFGVGVNDLPLSLVLSWFEQKAVTVLLALLALGVRNIRLGPNLPAFITPPVLKVLVDRFGIMPVGTVAEDLAAMGLAA

SEQ ID NO: 1747 - DNA, 1629 bp, Syntrophus aciditrophicus SB
  CDS (1)..(1629): transl_table=11
atgttttgttttcaatgtgagcagacggctggtggaacaggatgcacgaaaggcggcgtatgcgggaaaacgccggaagtggcggctctgcaggatcttctgatctacgagctgaaggggctgtccctgggcgccctcgaagcggacaaagtcggtatccacgacgaggaagtcgaccgctttacggttgaagcactcttttccaccctgaccaatgtggatttcgatcccgaccgtttcgtcgttcttctgaaccagggtgtgaagcttcgcgaacagctcagggaaaaagtgaaaaaagccggaggaaaggccgacttcgccgacgagtcagcgcttttccagcctgcggcaacgctggagggcctggtcgcccagggcgataaagtgggcatcaaatccgatcctcaggccgatcccgatgtgctggccctgaaggaactcctcatctacggcatcaagggggtcgcggcctacgccgatcatgcccgcatcctcgggaaaaccgatgcggcaataacgcggtttctctacgaagccctggccgctacgcgcaatgcagcactgggagtcaacgacctggtttccctcgtgctgaaatgcggggagatcaacctcaagaccatggaactcctcgacgccgcccacacggaaacctatggacaccccgttcccaccgccgttcccctgggggcaaagaaagggaaagccatcctcgtttccggacacgatctcaaggatctggatgaactcctgcaacagaccgccggaaaggggatcaacgtctacacccatggagagatgctccccactcacggttatccggggctgaagaagcatccccatttctacggccattacgggacggcctggcagaaccagaaaaaggaatttgccgccttcccgggcgccatcctcatgacgaccaactgcatccagaaacccgcggagtcctaccaggacaacatcttcaccgccggactcgtgggatggccgggggtcacccatatcgccgaccggaacttcactcccgtaatcgagaaagccctggccctgcacggatttccggaagatgttcccgggaaatcggtattagtcggtttcggcaggaatgccgttctcggcgtggccgacaaggtcatcgaaggcgtgaagagcaaggccatccgccatttcttcctggttgcgggctgcgacggcgccaagccgggacggaactactacacggagttcgtggaaaaggttccgaaggactgcgtggtccttaccctggcctgcggaaaattccgcttcttcgacaaggatctgggagacatcggcggcattccccggctgctcgacatcggccagtgcaatgacgcctactcggccatcgccatcgccggggcgctcgccaacgccttcggctgcggggtgaacgacctgcccctgtccatggttctctcctggtacgagcagaaggccgtggccatcctcctgaccctgctccatcttggaattcgggatatccggctggggcccagtcttccggccttcgtcacccccaacatcctgaacgtcctggtgcagaacttcaacatcatgcccatatcgacacctgacgaggatctgaaagcgatcctcggttaa

SEQ ID NO: 1748 - protein, 542 aa, Syntrophus aciditrophicus SB
MFCFQCEQTAGGTGCTKGGVCGKTPEVAALQDLLIYELKGLSLGALEADKVGIHDEEVDRFTVEALFSTLTNVDFDPDRFVVLLNQGVKLREQLREKVKKAGGKADFADESALFQPAATLEGLVAQGDKVGIKSDPQADPDVLALKELLIYGIKGVAAYADHARILGKTDAAITRFLYEALAATRNAALGVNDLVSLVLKCGEINLKTMELLDAAHTETYGHPVPTAVPLGAKKGKAILVSGHDLKDLDELLQQTAGKGINVYTHGEMLPTHGYPGLKKHPHFYGHYGTAWQNQKKEFAAFPGAILMTTNCIQKPAESYQDNIFTAGLVGWPGVTHIADRNFTPVIEKALALHGFPEDVPGKSVLVGFGRNAVLGVADKVIEGVKSKAIRHFFLVAGCDGAKPGRNYYTEFVEKVPKDCVVLTLACGKFRFFDKDLGDIGGIPRLLDIGQCNDAYSAIAIAGALANAFGCGVNDLPLSMVLSWYEQKAVAILLTLLHLGIRDIRLGPSLPAFVTPNILNVLVQNFNIMPISTPDEDLKAILG

SEQ ID NO: 1749 - DNA, 1629 bp, Syntrophus aciditrophicus SB
  CDS (1)..(1629): transl_table=11
atgttttgttttcaatgtgagcagacggcaggtggaacaggatgcacgaaaggcggcgtatgcgggaaaacgccggaagtggcggctctgcaggatcttctgatctacgagctgaaggggctgtccctgggcgccctcgaagcggacaaagtcggtatccacgacgaggaagtcgaccgctttacggttgaagcgctcttttccaccctgaccaatgtggatttcgatcccgaccgtttcgtcgttcttctgaaccagggtgtgaagcttcgcgaacagctcagggaaaaagtgaaaaaagccggaggaaaggctgacatcgccgacgagtcagcgcttttccagcctgcggcgacgctggagggcctggtcgcccagggcgataaagtgggcatcaaatccgatcatcaggccgatcccgatgtgctggccctgaaggaactcctcatctacggcatcaaggggggcgcggcctacgccgatcatgcccgcatcctcgggaaaaccgatgcggcaataacgcggtttctctacgaagccctggccgctacgcgcaatgcagcactgggagtcaacgatctggtttccctcgtgctgaaatgcggggagatcaacctcaagaccatggaactcctcgacgccgcccacacggaagcctatggacaccccgttcccaccgccgttcccctgggggcaaagaaagggaaagccatcctcgtttccggacacgatctcaaggatctggatgaactcctgcaacagaccgccggaaaggggatcaacgtctacacccatggagagatgctccccactcacggttatccggggctgaagaagcatccccatttctacggccattacgggacggcctggcagaaccagaaaaaggaatttgccgccttcccgggcgccatcctcatgacgaccaactgcatccagaaacccgcggagtcctaccaggacaacatcttcaccgccggactcgtgggatggccgggggtcacccatatcgccgaccggaacttcactcccgtaatcgagaaagccctggccctgcacggatttccggaagatgttcccgggaaatcggtattagtcggtttcggcaggaatgccgttctcggcgtggccgacaaggtcatcgaaggcgtgaagagcaaggccatccgccatttcttcctggttgcgggctgcgacggcgccaagccgggacggaactactacacggagttcgtggaaaaggttccgaaggactgcgtggtccttaccctggcctgcggaaaattccgcttcttcgacaaggatctgggagacatcggcggcattccccggctgctcgacatcggccagtgcaatgacgcctactcggccatcgccatcgccggggcgctcgccaacgccttcggctgcggggtgaacgacctgcccctgtccatggttctctcctggtacgagcagaaggccgtggccatcctcctgaccctgctccatcttggaattcgggatatccggctggggcccagtcttccggccttcgtcacccccaacatcctgaacgtcctggtgcagaacttcaacatcatgcccatatcgacacctgacgaggatctgaaagcgatcctcggttaa

SEQ ID NO: 1750 - protein, 542 aa, Syntrophus aciditrophicus SB
MFCFQCEQTAGGTGCTKGGVCGKTPEVAALQDLLIYELKGLSLGALEADKVGIHDEEVDRFTVEALFSTLTNVDFDPDRFVVLLNQGVKLREQLREKVKKAGGKADIADESALFQPAATLEGLVAQGDKVGIKSDHQADPDVLALKELLIYGIKGGAAYADHARILGKTDAAITRFLYEALAATRNAALGVNDLVSLVLKCGEINLKTMELLDAAHTEAYGHPVPTAVPLGAKKGKAILVSGHDLKDLDELLQQTAGKGINVYTHGEMLPTHGYPGLKKHPHFYGHYGTAWQNQKKEFAAFPGAILMTTNCIQKPAESYQDNIFTAGLVGWPGVTHIADRNFTPVIEKALALHGFPEDVPGKSVLVGFGRNAVLGVADKVIEGVKSKAIRHFFLVAGCDGAKPGRNYYTEFVEKVPKDCVVLTLACGKFRFFDKDLGDIGGIPRLLDIGQCNDAYSAIAIAGALANAFGCGVNDLPLSMVLSWYEQKAVAILLTLLHLGIRDIRLGPSLPAFVTPNILNVLVQNFNIMPISTPDEDLKAILG

SEQ ID NO: 1751 - DNA, 1650 bp, Desulfitobacterium hafniense Y51
  CDS (1)..(1650): transl_table=11
atgagtatgttctgttttcaatgtcaggaaaccgctaaaggaaccggctgtaccatcaaaggagtatgtggaaagactgcagatgtcgctaacctgcaggatcttctgctttatgtcatgaaaggaatcgctatcaacagcctgcaagcccgtgaactggggattgtccgccaagatgtagacaaattcgttatggaaggcttattcgccaccattaccaacgctaactttgataacgctcgtttcgtagctctggttcgcgaaggtcttgctttacgcgacagcttaaaagccgacatcgtcaaagccgggggagttctgcccgctaatcttcatgattcagcgatttggactgcagattctgcggaagaatttgagcaaaaggcagcacaagtaggtatcttagccactgaaaacgaagatgtacgctcccttcgtgaacttttaatctatggacttaaaggaatggccgcttacgcagagcatgccttcgctcttggctatgaagataacagcatctttgcctttatgatgaaaggcttggctgctactaccgatgacagcctttcggcagaccaactggtcgctctggtactcgaagctggaaaatacggcgtcgatgtcatggctcttctggataaagccaacacaacttcttacggcaaccctgaaatcaccaaggtcaatatcggcgtacgcaataaccctgccatcctcatcagcggtcacgacctgagagacttggaagatctcctcaagcaaaccgaaggaaccggcgtagatgtttatacccacggcgaaatgcttcccgctcactactatccggctttcaaaaagtatgctcactttgtgggtaactatggcaatgcctggtggaaacaagacaaagaatttgattcctttaacggagctattcttctcaccaccaactgtttagtaccccccaaggattcctataaagaccgtctcttcaccaccagtgtcgttggctacgaaggtgtaaaacacatccctgcccgtgaagcaggcaaagtcaaagacttctcggcagtgatcgaattagccaaaaccttgccggcacctaccgagatcgaaaccggagaaatcgtcggcggctttgctcataatcaagtctttgccgtagctgataaagtcgttgaagctgtaaaatccggagctgtaaaacgcttcttcgtcatggccggttgtgacggacggatgaagagccgcgattactatacagaattcgccaaagcccttccccaggacaccatcatcctcactgcaggctgtgccaaatataaatacaataaactggcactgggagacatcggtggtattcccagagtcctggatgccggacaatgcaacgactcctactccctggccgttattgctcttaagcttaaagaagtcttcggccttgacgatgtcaaccagcttcctatctcctacaacattgcctggtatgagcaaaaagcagtcatcgtactcctggcgctcctctacctgggcgtgaagaatatccacttaggacccactttgcctggattcctctctcccaacgtagccaaagttctggtcgagaacttcggaatcgccggtatcaccaccgtcgaagacgacgtcaacctcttcatgggtgcataa

SEQ ID NO: 1752 - protein, 549 aa, Desulfitobacterium hafniense Y51
MSMFCFQCQETAKGTGCTIKGVCGKTADVANLQDLLLYVMKGIAINSLQARELGIVRQDVDKFVMEGLFATITNANFDNARFVALVREGLALRDSLKADIVKAGGVLPANLHDSAIWTADSAEEFEQKAAQVGILATENEDVRSLRELLIYGLKGMAAYAEHAFALGYEDNSIFAFMMKGLAATTDDSLSADQLVALVLEAGKYGVDVMALLDKANTTSYGNPEITKVNIGVRNNPAILISGHDLRDLEDLLKQTEGTGVDVYTHGEMLPAHYYPAFKKYAHFVGNYGNAWWKQDKEFDSFNGAILLTTNCLVPPKDSYKDRLFTTSVVGYEGVKHIPAREAGKVKDFSAVIELAKTLPAPTEIETGEIVGGFAHNQVFAVADKVVEAVKSGAVKRFFVMAGCDGRMKSRDYYTEFAKALPQDTIILTAGCAKYKYNKLALGDIGGIPRVLDAGQCNDSYSLAVIALKLKEVFGLDDVNQLPISYNIAWYEQKAVIVLLALLYLGVKNIHLGPTLPGFLSPNVAKVLVENFGIAGITTVEDDVNLFMGA

SEQ ID NO: 1753 - DNA, 1620 bp, Methanococcoides burtonii DSM 6242
  CDS (1)..(1620): transl_table=11
atgttttgctaccagtgtgaagaaacaatgaacggcgaaggctgtacaaaaaacggcgtatgtgggaagaaaggggaggttgcagaccttcaggacgatctgatctatgtgcttaagagcgttgcattctacaaccagaaagcaagaaaggcagacatttctgaagagagcactgatgactttatgctcgatgcactgttctcaactataacgaataccgatttcagagcaacaggaattcaggatcgcattgacagaggatttgagatccagggtgagattaagcagaaacttctggataacaatgcactcgatgagaacgaactgcctgagatcgcaactgtgagcccggaaaacctcaaggacaggaataccggcatacttgcaacagagaacgaagatatccggtcattaagagagctgataatcttcggtatcaaaggaattgcagcatacggacatcatgcaatggtgcttgggcataccaataaaaaagttaattcatttatagaagagggactggtggcaaccacagatgatacccttaccgacaagaaactcatctcgcttgtactgaaatgtggggaaaaaggttttgatgtgatggcactgcttgacgcggcaaatacctctacattcggaaatccggaacccacccaggtcaatatcggaacgagaggtaatcccggaattctcgtaagcggtcacgacctcaatgacttgaaacaactgctggaccagactaaaggtaccggtgtcgatgtctatactcacggtgagatgttgcctgcaaattcatatcctgagtttaagaaatacgagcatctcgtaggcaactacggtggctcatggtggcatcagaaaaaggagttcgaaagcttcaacggccctatactgatgacaagtaactgtatcatacctccaaaggatacatatcttgacagaatatacactaccggttctgttggttttgatggggttgtacatcttaccggaaatgacggacaaaaggatttctcagctataattgaacaagctaagaaatgcgaaccacctgtccaacttgaagagggaactatcatgggcggttttgcctacaattccgtcctctctgttgcagacaagatcgttgatgccgtcaaagcaggcaagataaagaagttcattgtaatggcagggtgtgatggacgccggaaggacagacagtattatacagattttgcagaagcactcccaaaggatactgtcatactgactgccggatgtgcaaaatatcgctacaataaacttaaccttggagacattgatggaattccaagggtgctggatgcaggccaatgtaatgattcattttcactggtcatcattgcacaaggacttatggccagacttggatttacggatgttaatgaagcaccgatctcttacaatatcgcatggtacgaacaaaaggcaatcattgtgttgcttgccctgttaagaatgggaatacaggatattaccctcggaccaaagcttccggcctttgtgtcacctaatgtcctcaacgtgctggtagagaagttcaatatcacaccgaacaccacagtcgaagaggatatggagaggctgctgaaataa

SEQ ID NO: 1754 - protein, 539 aa, Methanococcoides burtonii DSM 6242
MFCYQCEETMNGEGCTKNGVCGKKGEVADLQDDLIYVLKSVAFYNQKARKADISEESTDDFMLDALFSTITNTDFRATGIQDRIDRGFEIQGEIKQKLLDNNALDENELPEIATVSPENLKDRNTGILATENEDIRSLRELIIFGIKGIAAYGHHAMVLGHTNKKVNSFIEEGLVATTDDTLTDKKLISLVLKCGEKGFDVMALLDAANTSTFGNPEPTQVNIGTRGNPGILVSGHDLNDLKQLLDQTKGTGVDVYTHGEMLPANSYPEFKKYEHLVGNYGGSWWHQKKEFESFNGPILMTSNCIIPPKDTYLDRIYTTGSVGFDGVVHLTGNDGQKDFSAIIEQAKKCEPPVQLEEGTIMGGFAYNSVLSVADKIVDAVKAGKIKKFIVMAGCDGRRKDRQYYTDFAEALPKDTVILTAGCAKYRYNKLNLGDIDGIPRVLDAGQCNDSFSLVIIAQGLMARLGFTDVNEAPISYNIAWYEQKAIIVLLALLRMGIQDITLGPKLPAFVSPNVLNVLVEKFNITPNTTVEEDMERLLK

SEQ ID NO: 1755 - DNA, 1689 bp, Methanococcoides burtonii DSM 6242
  CDS (1)..(1689): transl_table=11
atgtattgctatcaatgtgaagaaactattaacggacaatcctgtaccaaagccggagcatgcggaaagacagcgaatgttgcagaccttcaggaccaacttacatacatcctcaaggggatcgcatattataatcagaaagcaagggagaatgggataaaagacaaaaatgtcgatagcttcctcatgaaagcactattctcaactgtcactaacactaatttcagttcaagtgactttaataagttcatcaatgaaggcatctcactgagagagagcatcaaaaagaacctcacaacaaggaaaatcaaccttggaaaaacaaaggacatgtccttcggtgaaaaggtaaaaacaacccttggagtaagccatcctgagacaaggttcaccatcccggaagctgcaataatcaatactgaagcattgaagacagcaagcgtaggagttcttaatacccagaacgaagacatcagatccctcagagagctgctggtctacggtttgaaaggtctggctgcatatgcacaccatgcagaagttcttggatacaccgatgagacactatccgagttcgccgaaaaggcacttgcttcaacccttgatgacagcctgagtgttgatgatctagtaggacttgtcctcgaatgtggaaaatatggtgtcaatgtaatggcgcttcttgacaaggcaaatacgtccacctatggcaatcctgaaccaacggaagttttcctgggcacaagggacaatccgggtatcctcattagtggacatgaccttaaggacatggaacagttgctcaaacggaccgaaggcactggtgtcgatgtttatacccacggcgaaatgcttcctgcaaactactatccagcattcaagaaatatgaccactttgtcggaaactatggcggttcatggtggaaccagaagaacgaattcgaaacgttcaatggtcctatactcatgacaacaaactgtcttgtccctccaaaaaacagttacatcaacagagtctacaccacaagcgtagtcggtttcgatggggtcaaacacatcgatgctaaagaggatggcacaaaggacttctccgccatagtagaacaggcaattgcatgccagcccccaaaacaacttgaagacggcacaatagttggcggattcgcacatgctgctgttctctccgtagctgataaggtcatcgaagctgtaaaggccggaaagatcacacgctttatcgtcatggcaggctgtgacggaaggcataaggaaagggattactacaccaaatttgcagaagcccttcctgagagtgcggtcatcctgacagcaggttgtgcaaaataccgttacaataaactgaaccttggtgacatcgatgggatcccaagggtcctggatgcaggacagtgtaatgactcgtattcccttgtggtcattgcacagaagcttgccgaagctttcggccttgaggacataaatgacctgccagtatcatacaacatcgcatggtatgaacaaaaagcagtacttgtcctgcttgcactgctccacctcggtgtcaagaacataacacttggaccgacactgccggcatttgtgtccccgaatgtactcaatgtactcgttgagaactttaacattgcacccaacacaaccgttgaagaggatctgacgaggctactctaa

SEQ ID NO: 1756 - protein, 562 aa, Methanococcoides burtonii DSM 6242
MYCYQCEETINGQSCTKAGACGKTANVADLQDQLTYILKGIAYYNQKARENGIKDKNVDSFLMKALFSTVTNTNFSSSDFNKFINEGISLRESIKKNLTTRKINLGKTKDMSFGEKVKTTLGVSHPETRFTIPEAAIINTEALKTASVGVLNTQNEDIRSLRELLVYGLKGLAAYAHHAEVLGYTDETLSEFAEKALASTLDDSLSVDDLVGLVLECGKYGVNVMALLDKANTSTYGNPEPTEVFLGTRDNPGILISGHDLKDMEQLLKRTEGTGVDVYTHGEMLPANYYPAFKKYDHFVGNYGGSWWNQKNEFETFNGPILMTTNCLVPPKNSYINRVYTTSVVGFDGVKHIDAKEDGTKDFSAIVEQAIACQPPKQLEDGTIVGGFAHAAVLSVADKVIEAVKAGKITRFIVMAGCDGRHKERDYYTKFAEALPESAVILTAGCAKYRYNKLNLGDIDGIPRVLDAGQCNDSYSLVVIAQKLAEAFGLEDINDLPVSYNIAWYEQKAVLVLLALLHLGVKNITLGPTLPAFVSPNVLNVLVENFNIAPNTTVEEDLTRLL

SEQ ID NO: 1757 - DNA, 1644 bp, Clostridium perfringens ATCC 13124
  CDS (1)..(1644): transl_table=11
atgttttgttttcaatgtcaagaaacagcaggatgcaaaggctgtactgtaagaggtgtttgtggaaaaactgaagatgtagcaaaaatacaagaccttttaatttttgttactaaaggattagctacagtagctaatgaaggaagaaaagtaggaatagtagataaaaaaataaacagaatgataatagataacctatttattactattactaatgcaaactttgattttaaagcaatagaaaaaagagttaaagatactttagtagcaagagaagagctaaaagaaagagtacaagctaagggtggaaatccagttggatcagacttcaaaggatgtgcaacttggacagctacaactagtgaggaaatgatggaaaaagcttcacaagtaggagttttagctacagaaaatgaagatataagaagtttaagagagcttattatgtatggattaaaaggattagcagcatacatggagcatgctatgaatttaggacatgataaagaagaagttcatgcatttatggcagaaactttagttaaaatattagatgattcattaagtgcagatgaattaacagctttagcattagaaacaggaaaattcggtgttgatggaatggcattattagatgaagctaacacttcaacttacggtcatccagaaataacaaaagttaatataggagttagaaataacccaggaatattaatatcaggacatgatttaaaagacttagaaatgctattagaacaaacagaaggaactggagtagatgtttatactcatggtgaaatgttaccaggacactactatccaaaattcaagaaatattctcactttgcaggaaactatggtaatgcatggtggttacaaaataaagaattcgcatcatttaatggaccaatattaatgacaacaaactgtataacaccagttcaagactcatatagaggaagaatattcacaacaggtgctgtaggatatgaaggatgtattcatataacagctgatgaaaatggacacaaagatttctcacaaataatagagttagctaagacttgcaaagctccaacagagattgaaacaggggaaatcgtaggtggatttgctcataaccaagtacttgctttagctgaccaagtagttgatgctgttaaatcaggtgcaataagaagattcttcgtaatggctggatgtgatggaagagctaaatcaagagattactatagagaatttgctgaaaaattaccaaaagacactgttatattaacagctggatgtgctaaatataaatataataaattaccacttggagatatcaatggaattccaagagttttagatgcaggacaatgtaatgattcatactcattagttgtaatagctttaaaacttgctgaagtatttggaacagatagtgtaaatgaattaccaataagctacaacatagcatggtatgaacaaaaagctgtaatagtattattatcattattacacttaggtgttaaaaacattcacttaggaccaactttaccagcattcttatcaccaaacgtagctaaagttttagttgagaactttggaattggtggaattacaaatgtagaagatgatatgaaaatgttcttaggagaataa

SEQ ID NO: 1758 - protein, 547 aa, Clostridium perfringens ATCC 13124
MFCFQCQETAGCKGCTVRGVCGKTEDVAKIQDLLIFVTKGLATVANEGRKVGIVDKKINRMIIDNLFITITNANFDFKAIEKRVKDTLVAREELKERVQAKGGNPVGSDFKGCATWTATTSEEMMEKASQVGVLATENEDIRSLRELIMYGLKGLAAYMEHAMNLGHDKEEVHAFMAETLVKILDDSLSADELTALALETGKFGVDGMALLDEANTSTYGHPEITKVNIGVRNNPGILISGHDLKDLEMLLEQTEGTGVDVYTHGEMLPGHYYPKFKKYSHFAGNYGNAWWLQNKEFASFNGPILMTTNCITPVQDSYRGRIFTTGAVGYEGCIHITADENGHKDFSQIIELAKTCKAPTEIETGEIVGGFAHNQVLALADQVVDAVKSGAIRRFFVMAGCDGRAKSRDYYREFAEKLPKDTVILTAGCAKYKYNKLPLGDINGIPRVLDAGQCNDSYSLVVIALKLAEVFGTDSVNELPISYNIAWYEQKAVIVLLSLLHLGVKNIHLGPTLPAFLSPNVAKVLVENFGIGGITNVEDDMKMFLGE

SEQ ID NO: 1759 - DNA, 1665 bp, Shewanella sp. MR-4
  CDS (1)..(1665): transl_table=11
atgttttgtattcagtgtgagcaaactattcgtacccccgccggcaacggttgtagctatgcccaaggtatgtgtggcaaattggccgcgacctcggatctgcaagacttgttaatctacatgctgcagggtgtttcagtgtatgcgactaaggctcgtgaactgggcgtcgttgaccctgaggtggatacctttgttcctaaagcttttttctcgaccttaaccaacgttaacttcgatgatgaacgcatcatcgcctatgccaagcaggcggctgagtaccgtgaaagtttaaaaaatgcctatgaagcggcgtgtgaagctgcgggtaaatcggctgaatcgctccctcctgtggcgcaatttgtactgggtaccagtaagcccgaaatgttgtctcaagcgccagtcgccttactcaataaagataaaaatgatatccacgaagatatccttgggctgagactactgtgcttatatggccttaaaggtgcggcggcttacatggagcacgcccgtgtattaggtaaaaccgacgctgagattgctggtcgcttccatgagattatggcgtttctcggtgagccgagcgtcgatgccgataaactgttcataacagccatggatattggtcaactgaactaccgcatcatggcgatgctcgatgcgggcgagaccgaagccttcggtcatccggaaccgactgtcgtcaacactaaagcggttaaaggcaaagcgattctggtttctggccatgatatgaaggatttagagcttatcctcgagcaaacggcgggtaaaggcattaatgtttatacccatggcgaaatgctccccgcgctggcgtatcccgcctttaaaaaatatgctcatttagtgggtaactacggcagtgcatggcagaaccagcaaaaagaatttgctaatttccctggcgccgtagtgatgacctcaaactgtattattgacccgaatgtgggccaatacagcgaccgtatctttacccgcagtatcgtgggttggcctggtgtaacccatgtggttggggacgatttttcagttgtgatcgacaaggcgctcgctcttgatggcttccaatacgatgaaatcccacacaatatcactatcggttttgcccgtaatgccttaatggctgcggcaccgactgtggttgaaaacgtgaaaaacggttctatcaaacacttcttcttagtcggtggctgtgatggcgataagtctgagcggagttatttcactgacttagcgaaatcggcgccaaaggattccgttatcctgaccttaggttgtggtaagtacaaattcaacaagctggaatttggcgatatcaacggtattccgcgcttactcgatattggccaatgtaacgatgcctattcggctattcagttggctatcgcgctatcacaaatttttgaatgcgatatcaatgaattaccattgaacctcgtgctttcatggtttgagcagaaagccattgtcgtgctgctgacgctattgtcgcttggggtgaaaaatatccgtaccggcccgacgccgccagcgtttttaacggctaatcttgccaaaattttggaagaaaaatttggcctgcgtaacaccaccacagttgaagccgatcttaaaaccatgctgaacgtggcatag

SEQ ID NO: 1760 - protein, 554 aa, Shewanella sp. MR-4
MFCIQCEQTIRTPAGNGCSYAQGMCGKLAATSDLQDLLIYMLQGVSVYATKARELGVVDPEVDTFVPKAFFSTLTNVNFDDERIIAYAKQAAEYRESLKNAYEAACEAAGKSAESLPPVAQFVLGTSKPEMLSQAPVALLNKDKNDIHEDILGLRLLCLYGLKGAAAYMEHARVLGKTDAEIAGRFHEIMAFLGEPSVDADKLFITAMDIGQLNYRIMAMLDAGETEAFGHPEPTVVNTKAVKGKAILVSGHDMKDLELILEQTAGKGINVYTHGEMLPALAYPAFKKYAHLVGNYGSAWQNQQKEFANFPGAVVMTSNCIIDPNVGQYSDRIFTRSIVGWPGVTHVVGDDFSVVIDKALALDGFQYDEIPHNITIGFARNALMAAAPTVVENVKNGSIKHFFLVGGCDGDKSERSYFTDLAKSAPKDSVILTLGCGKYKFNKLEFGDINGIPRLLDIGQCNDAYSAIQLAIALSQIFECDINELPLNLVLSWFEQKAIVVLLTLLSLGVKNIRTGPTPPAFLTANLAKILEEKFGLRNTTTVEADLKTMLNVA

SEQ ID NO: 1761 - DNA, 1665 bp, Shewanella sp. MR-7
  CDS (1)..(1665): transl_table=11
atgttttgtattcagtgtgagcaaactattcgtaccccagctggcaacggttgtagctatgcccaaggcatgtgtggcaaattggccgcgacctcggatctgcaagatttgttaatctatatgctgcagggtgtttcagtgtatgcgactaaggcgcgtgaactgggcgtcattaaccctgaggtggatacctttgttcctaaagcttttttctcaaccttaaccaacgttaacttcgatgatgaacgcatcatcgcctatgccaagcaggccgctgagtaccgtgaaagtttaaaaaatgcctatgaagcggcgtgtgaaactgcgggtaaacgggctgaatcgctcccacctgtggcgcaatttgtactgggtaccagcaagcctgaaatgttgtctcaagcgccagtcgccttactcaataaagataaaaatgagatccacgaagatatccttgggctgagactactgtgcttatatggccttaaaggggcagcggcttacatggagcatgcccgtgttttaggtaaaaccgatgctgagattgctggtcgcttccatgagatcatggcgtttcttggtgagccgagtgtcgatgccgataaactgttcacaacagccatggatattggtcagctaaactaccgtatcatggccatgctcgatgcgggcgagaccgaagccttcggtcatccagaaccgactgtcgtcaacactaaacccgttaaaggcaaagcgattctggtttctggccatgatatgaaggacttagagcttatcctcgagcaaactgcaggtaaaggcattaatgtttatacccatggtgaaatgctgcctgcgcttgcgtatcctgcctttaaaaaatatgcccatttagtgggtaactacggcagtgcatggcagaaccagcaaaaagaattcgctaatttccccggcgccgtagtgatgacttcaaactgtattatcgacccgaatgtgggccaatatagcgaccgtatctttacccgcagtatcgtgggttggcctggtgtgacccatgtaattggggatgatttttcagttgtgatcgacaaggctctctcactcgatggcttccaatacgatgaaattccacacaatatcaccattggttttgcccgtaatgccttaatggccgcagcaccgactgtggtggaaaacgtcaaaaacggttctatcaaacacttcttcttagtcggaggttgtgatggtgataagtcggagcggagttatttcaccgatttagctaaatcggcgccaaaggattccgtcatcctgaccttaggttgtggtaagtacaaattcaacaagctggaatttggcgatatcaacggtattccgcgcttactcgacattggccaatgtaacgatgcctattcggctattcagttggctatcgcgctatcacaaatctttgaatgcgatatcaatgaattaccattgaacctcgtgctttcatggtttgagcaaaaagccattgtcgtgctgctgacgctattgtcgcttggggtgaaaaacatccgtaccggcccaacgccgccggcgtttttaacggcgaatcttgccaaaattttggaagaaaaatttggcctgcgtaacaccaccacagttgaagccgatcttaaaaccatgctgaacgtggcatag

SEQ ID NO: 1762 - protein, 554 aa, Shewanella sp. MR-7
MFCIQCEQTIRTPAGNGCSYAQGMCGKLAATSDLQDLLIYMLQGVSVYATKARELGVINPEVDTFVPKAFFSTLTNVNFDDERIIAYAKQAAEYRESLKNAYEAACETAGKRAESLPPVAQFVLGTSKPEMLSQAPVALLNKDKNEIHEDILGLRLLCLYGLKGAAAYMEHARVLGKTDAEIAGRFHEIMAFLGEPSVDADKLFTTAMDIGQLNYRIMAMLDAGETEAFGHPEPTVVNTKPVKGKAILVSGHDMKDLELILEQTAGKGINVYTHGEMLPALAYPAFKKYAHLVGNYGSAWQNQQKEFANFPGAVVMTSNCIIDPNVGQYSDRIFTRSIVGWPGVTHVIGDDFSVVIDKALSLDGFQYDEIPHNITIGFARNALMAAAPTVVENVKNGSIKHFFLVGGCDGDKSERSYFTDLAKSAPKDSVILTLGCGKYKFNKLEFGDINGIPRLLDIGQCNDAYSAIQLAIALSQIFECDINELPLNLVLSWFEQKAIVVLLTLLSLGVKNIRTGPTPPAFLTANLAKILEEKFGLRNTTTVEADLKTMLNVA

SEQ ID NO: 1763 - DNA, 1665 bp, Shewanella sp. ANA-3
  CDS (1)..(1665): transl_table=11
atgttttgtattcagtgtgagcaaactattcgtaccccagctggcaacggttgtagctatgcccaaggcatgtgtggcaaattggccgcgacctcggatctgcaagatttgttaatctatatgctgcagggtgtttcagtgtatgcgactaaggcgcgtgaactgggcgtcattaaccctgaggtggatacctttgttcctaaagcttttttctcaaccttaaccaacgttaacttcgatgatgaacgcatcatcgcctatgccaagcaggccgctgaataccgtgaaagtttaaaaaatgcctatgaagcggcgtgtgaagctgcgggtaaacgggctgaatcactccctcctgtggcgcaatttgtactgggtaccagcaagcccgaaatgttgtctcaagcaccagtcgccttactcaataaagataaaaatgagatccacgaagatatccttgggctgagactactgtgcttatatggccttaaaggggctgcggcttacatggagcacgcccgtgttttaggtaaaaccgatgctgagattgctggtcgcttccatgaaatcatggcgtttcttggtgagccgagtgtcgatgccgataaactgttcactacagccatggatattggtcagctgaactaccgtatcatggccatgctcgatgcgggcgagaccgaagcctttggtcatcctgaaccgactgtcgtcaacactaaaccggtaaaaggcaaagcgattctggtttctggccatgatatgaaggacttagagcttatcctcgagcaaacggcgggcaaaggcattaatgtttatacccatggtgaaatgctgcctgcgcttgcgtatcccgcctttaaaaaatatgcccatttagtaggtaactacggcagtgcatggcagaaccagcaaaaagaattcgctaatttccccggcgctgtagtgatgacctcaaactgtattatcgacccgaatgtgggccaatatagtgaccgtatctttacccgcagtatcgtgggttggcctggtgtgacccatgtaattggggatgatttttcagttgtgatcgacaaggctctttcacttgatggcttccaatacgatgaaattccacacaatatcaccatcggttttgcccgtaatgccttaatggccgcagcaccgactgtggtggaaaacgtcaaaaacggttctatcaaacacttcttcttagtcggaggttgtgatggtgataagtcggagcggagttatttcaccgatttagcgaaatcggcgccaaaggattccgtcatcctgaccttaggttgtggtaagtacaaattcaacaagctggaatttggcgatatcaacggtattccgcgcttactcgacattggccaatgtaacgatgcctattcggctattcagttagctattgcactatcacaaatctttgaatgcgatatcaatgaattaccattgaacctcgtgctttcatggtttgagcaaaaagccattgtcgtgctactgacgctgttgtcgctcggggtgaaaaacatccgcaccggcccaacgccgccagcgtttttaacggctaatcttgccaaaattttggaagaaaaatttggtctgcgtaacaccaccacagttgaagccgatctgaagaccatgctgaacgtggcctag

SEQ ID NO: 1764 - protein, 554 aa, Shewanella sp. ANA-3
MFCIQCEQTIRTPAGNGCSYAQGMCGKLAATSDLQDLLIYMLQGVSVYATKARELGVINPEVDTFVPKAFFSTLTNVNFDDERIIAYAKQAAEYRESLKNAYEAACEAAGKRAESLPPVAQFVLGTSKPEMLSQAPVALLNKDKNEIHEDILGLRLLCLYGLKGAAAYMEHARVLGKTDAEIAGRFHEIMAFLGEPSVDADKLFTTAMDIGQLNYRIMAMLDAGETEAFGHPEPTVVNTKPVKGKAILVSGHDMKDLELILEQTAGKGINVYTHGEMLPALAYPAFKKYAHLVGNYGSAWQNQQKEFANFPGAVVMTSNCIIDPNVGQYSDRIFTRSIVGWPGVTHVIGDDFSVVIDKALSLDGFQYDEIPHNITIGFARNALMAAAPTVVENVKNGSIKHFFLVGGCDGDKSERSYFTDLAKSAPKDSVILTLGCGKYKFNKLEFGDINGIPRLLDIGQCNDAYSAIQLAIALSQIFECDINELPLNLVLSWFEQKAIVVLLTLLSLGVKNIRTGPTPPAFLTANLAKILEEKFGLRNTTTVEADLKTMLNVA

SEQ ID NO: 1765 - DNA, 1737 bp, Fusobacterium nucleatum subsp. vincentii ATCC 49256
  CDS (1)..(1737): transl_table=11
atggataaaatgttttgttatcaatgtcaagaaactgctaagggaactggatgtacttcaataggagtttgtggaaaaacatctgaaacatcaggattacaagatttattattgtatacagaaaaaggagttgcagcatatagtgcaatttttagaaaagaaggtaaagcaaaagaattaataaaaaacaaagtaaatagatatcttattaattcactttttataacaattacaaatgctaactttgatgatactgcaatattagatgaaataaaagcaggattaaaattaagagaagaattaaaagcacttgcaactgatgaagaaaagaaagaagcagaaaaatatggtactaatttagtaaattggtattatgaatcagatgaagatttaataaaattttctgaaaatcaatcagtagttggagtattaagaacagaaaatgaagatgttagatctttaagagaattaataatgtatggattaaaaggaatggcagcttatgcagaacatgcttttaacttaggaaaaacaagtgaagaaatattcgcttttatagaagaagctcttttaggaactatggatgacagcttaaatgcagaacaattagttgctttaacaatgaaaacaggagaatatggagttaaagtaatggcattattagatgaagctaatacatctgcattaggaacacctgaaattacaaaagtaaaaattggagctggaaaaagaccaggaattttaataagtggacacgacttatgggatttaaaacaattattggaacaaagtaaagattcaggagtagacatctatactcactctgaaatgttaccaggacatggatatcctgaattaaagaaatattctcatttctatggaaactatggaaatgcttggtgggatcaaagaaaagactttacaaactttaatggacctattgttttcacaactaactgtatagttccacctttaaataatgcttcatataaagatagagtatttacaactaatgctgctggatatccaggttggaaaagaataaaagttaatgcagatggaacgaaagatttctctgaaattatagaacttgcaaaaacttgtcaacctccaaaagaaatagaaagtggagaaataattgttggtttcgctcataatcaagttttaagtttagctgataaaatagtagaaaatattaaatcaggagcaatcaaaagattcattgtaatgagtggttgtgatggaagaatgaaacaaagacattactatacagaatttgctgaaaacttgccaaaaaatactattattttaacttctggttgtgctaaatataaatataataaattaaatttaggagatataaatggtattccaagagtattagatgctggacaatgtaatgactcatattcttgggcagtagtagctcttaaattaaaagaagtatttggattaaatgatattaatgagttaccaatagtatttaatatagcttggtatgaacaaaaagctgttatagttttacttgcattactatatttaggaataaaaaatattcatgttggaccaacattaccaggtttcttatcaccaaatgtagcaaaagttttagtagaaaattttggtatagctggaattacaacagtagaagaagatttaaagaaattcggtttatatgaaggatcagtgttagcaaatatttctaataaagaaacttcaaatgaagctagaatttaa

SEQ ID NO: 1766 - protein, 578 aa, Fusobacterium nucleatum subsp. vincentii ATCC 49256
MDKMFCYQCQETAKGTGCTSIGVCGKTSETSGLQDLLLYTEKGVAAYSAIFRKEGKAKELIKNKVNRYLINSLFITITNANFDDTAILDEIKAGLKLREELKALATDEEKKEAEKYGTNLVNWYYESDEDLIKFSENQSVVGVLRTENEDVRSLRELIMYGLKGMAAYAEHAFNLGKTSEEIFAFIEEALLGTMDDSLNAEQLVALTMKTGEYGVKVMALLDEANTSALGTPEITKVKIGAGKRPGILISGHDLWDLKQLLEQSKDSGVDIYTHSEMLPGHGYPELKKYSHFYGNYGNAWWDQRKDFTNFNGPIVFTTNCIVPPLNNASYKDRVFTTNAAGYPGWKRIKVNADGTKDFSEIIELAKTCQPPKEIESGEIIVGFAHNQVLSLADKIVENIKSGAIKRFIVMSGCDGRMKQRHYYTEFAENLPKNTIILTSGCAKYKYNKLNLGDINGIPRVLDAGQCNDSYSWAVVALKLKEVFGLNDINELPIVFNIAWYEQKAVIVLLALLYLGIKNIHVGPTLPGFLSPNVAKVLVENFGIAGITTVEEDLKKFGLYEGSVLANISNKETSNEARI

SEQ ID NO: 1767 - DNA, 1629 bp, Prosthecochloris aestuarii DSM 271
  CDS (1)..(1629): transl_table=11
atgggcatgtattgtgatcaatgtcaggaaagtgtgaaagggacgggatgtattacccggggggtatgcggcaagagtgatgtgacagcgaagcttcaggatacgcttgtctatgctctcgaaggggttgctctctgcgctgaggcctcaggcaataaactggatcccgatcacgggcgatttttgagccaggctctgtttataacggtaaccaacaccaatttcgatgacgatgctattgtcgataagatttttgaagcgcttgctctgcgcgatgaacttcggagtcagctgaccgatacgctgccgtacgatgccgtaaactggttgggtgagagcaaagaggattttgtgaggaaagcagaaactgcgggtattagggcattaagtcataatgatgatttgcgcgctctcaaaagtcttgcgctctatggcctcaaagggcttgccgcctatgcagatcatgccgaagtgctcggctatgtcgatcatgcgatctatgatttttacgtgaccgccctggccgctcttgccaaagatctggatggagatcaccttacagctcttgtaatggaaaccggttccatcgctgtcaaagcgatggctctgctcgacaaggcaaatactgaaacctatggcaatcctgtcgtgacaacggtgaagaccggtgttggcagccgtcccggaatccttatttccggccatgatctcaaggatatggacgagttgctcaagcagaccgaggggagcggtgtcgatgtctatacccactgcgagatgcttcctgcgcattactatcccgcattccagaaatattcccattgtatcggcaattacggcagttcatggtggtctcaggataaagagttcgagtcttttaacggtccgatccttatgacgaccaactgtatcgttccggtccgggagtcctatcgcaaccgcatgtttacgacaggcaatgctggttacgagggcgttcagcacatttcgggcggagaaaacgggtcggtcaaggacttttccgctcttgtggagctggcgaaaacatgccagccgcctgttgagcttgaaaacggagagattgtcggcggatttgcccacaatcaggttgtcgctcttgccgacaaggttgtcgatgcggtcaagtcaggagcgatcaagcgtttcgtcgtcatggctggatgtgatgggcgccataagagcaggcagtattataccgatgttgctgaagcgctttcggaagagacggtgattcttaccgccgggtgtgcaaaataccgctacaacaagcttcagcttggtgatatcggcggtattccacgagtgctcgatgccggtcagtgcaacgactcctactcgcttgcggtcatcgcattgaagctcaaagaggttttcggactcgacgacatcaatgatctgccgatatcctatgatattgcctggtatgagcagaaagctgtggcggtgcttcttgcgctgttgtctctgggtgtcaaggggatccgtctcggaccgacgcttcccgagtttcttactccggctgttgtctctgtgcttgttgataaatttgatattaaacctatcggaacggttcaggacgatgtgcttgcgatgatggccggtcagtga

SEQ ID NO: 1768 - protein, 542 aa, Prosthecochloris aestuarii DSM 271
MGMYCDQCQESVKGTGCITRGVCGKSDVTAKLQDTLVYALEGVALCAEASGNKLDPDHGRFLSQALFITVTNTNFDDDAIVDKIFEALALRDELRSQLTDTLPYDAVNWLGESKEDFVRKAETAGIRALSHNDDLRALKSLALYGLKGLAAYADHAEVLGYVDHAIYDFYVTALAALAKDLDGDHLTALVMETGSIAVKAMALLDKANTETYGNPVVTTVKTGVGSRPGILISGHDLKDMDELLKQTEGSGVDVYTHCEMLPAHYYPAFQKYSHCIGNYGSSWWSQDKEFESFNGPILMTTNCIVPVRESYRNRMFTTGNAGYEGVQHISGGENGSVKDFSALVELAKTCQPPVELENGEIVGGFAHNQVVALADKVVDAVKSGAIKRFVVMAGCDGRHKSRQYYTDVAEALSEETVILTAGCAKYRYNKLQLGDIGGIPRVLDAGQCNDSYSLAVIALKLKEVFGLDDINDLPISYDIAWYEQKAVAVLLALLSLGVKGIRLGPTLPEFLTPAVVSVLVDKFDIKPIGTVQDDVLAMMAGQ

SEQ ID NO: 1769 - DNA, 1629 bp, Prosthecochloris aestuarii DSM 271
  CDS (1)..(1629): transl_table=11
atgggaatgtattgtgatcagtgccaggaaagcgtgaaaggcacaggatgtattgcaagaggcgtgtgcggaaaaaacgaagtcactgccaaacttcaggatacgcttgtctatatacttgagggacttgcactttgcgcggaagctgcagggaaatctatagatgacaacgtaggccgattgatcggtgaaggattgtttgttaccgtaaccaacaccaattttgatgatgacgctatcacagaaaagattcgggaaacgatagcgctgcgggatcagctgaaaacaacacttgcttccgtaccggaccatgactgtgtcagctggaatggctcgacaaaagaggagttcgtgggcaaagcagagcgctccggcattgaagcgctgagtacccatgaagatcttcgatcgctcaaaagtcttatcctgtacggtctgaaagggcttgcggcttataccgaccatgcggctgtccttggctataccgacgatgcaatccatcagttttacgttactgcgcttgcagcattggcaaaggacctcgatgccgattctctgcttggtctgacgatggagaccggcaatattgccgtgaaagcgatggcgctgctcgacaaagccaacactgaaacctacggtaatccggaaatcaccaaagtcaatattggcgtcgggaaccgcccgggcatcctgatttccggtcatgacctgaaagacatggaagagctgctcaaacagactgagggcactgatgtggatgtctatacgcactgtgaaatgctcccggctcactactatccggcattcaagaaatactcgcatttcgtaggcaactacggaagctcctggtgggcacaggacaaggaattcgaatcgttcaacggaccgattctcatgacgaccaactgcattgttcctgtgaaagagtcctacagaggacgcttgtttaccacaggaaatgcaggctatgaaggtgtcaggcatatccctgctcccaaagacggatcatccaaggacttttcggaaatgatcaaactggccggaacctgcaaaccgcctgttgaaatcgaaaccggtgaaattatcggaggatttgcccataaccaggtaatcgctctggctgacaaggttgtcgatgcggttcaaagtggagctatcaagcgctttgtcgtgatggccggatgcgatggacgccacaacagcagaaaatactataccgatgttgccggacaactgccgaaagatacggtaatcctgacagctggatgtgccaagtaccgctacaacaaactccagctgggcgatattggtggtattccaagggttctcgatgccggtcagtgtaatgactcctattcgctggcggtgattgccatgaagttgaaagaggttttcgggctggatgatatcaacgacctgccgatatcctatgacattgcgtggtacgaacagaaagccgtagccgtccttcttgcgttgctggctcttggggtaaaagggatccggctcggaccgacgctccccgaattcctgacgccgaacattgccgcagctcttgtcgaaaaatttgacatcaagccgatcgacactgctgagtcagatatctcagccatgatggctggtgcataa

SEQ ID NO: 1770 - protein, 542 aa, Prosthecochloris aestuarii DSM 271
MGMYCDQCQESVKGTGCIARGVCGKNEVTAKLQDTLVYILEGLALCAEAAGKSIDDNVGRLIGEGLFVTVTNTNFDDDAITEKIRETIALRDQLKTTLASVPDHDCVSWNGSTKEEFVGKAERSGIEALSTHEDLRSLKSLILYGLKGLAAYTDHAAVLGYTDDAIHQFYVTALAALAKDLDADSLLGLTMETGNIAVKAMALLDKANTETYGNPEITKVNIGVGNRPGILISGHDLKDMEELLKQTEGTDVDVYTHCEMLPAHYYPAFKKYSHFVGNYGSSWWAQDKEFESFNGPILMTTNCIVPVKESYRGRLFTTGNAGYEGVRHIPAPKDGSSKDFSEMIKLAGTCKPPVEIETGEIIGGFAHNQVIALADKVVDAVQSGAIKRFVVMAGCDGRHNSRKYYTDVAGQLPKDTVILTAGCAKYRYNKLQLGDIGGIPRVLDAGQCNDSYSLAVIAMKLKEVFGLDDINDLPISYDIAWYEQKAVAVLLALLALGVKGIRLGPTLPEFLTPNIAAALVEKFDIKPIDTAESDISAMMAGA

SEQ ID NO: 1771 - DNA, 1695 bp, delta proteobacterium MLMS-1
  CDS (1)..(1695): transl_table=11
atgttttgttatcaatgtgagcagacggccaagggcgagggttgcaagaccataggggtttgcggcaagaaaccggaagtggcggccctgcaggacttgctgatttatgcgctgcaggggctgtccctggtggcggtggcaggtcgcaaggtgggagtcaacgacggggaagttaaccttttcacctgtgaagcggtgttttccaccttaaccaatgtcgatttcgacccggagcgctttgtcgctctgattaaacggactgtcagcctgcgcgaggccctgttgcccaaagtgcaggccgccggtggccaggtggatagcagcgtcgccgccgttacctttacccccgccgccgaccaggccgaaatggtcaagcagggtgaagagatcgacatgaagaactccgccgacgatgatgccgatatccagtcgctcaagcatatcctgcttttcggccttaagggcgtggccgcctacgccgaccatgccaagatcctgggccaggaggacgaccaggtctacgcctttatccaggagggcctggtcaacctgctgcgccgggacatggggctgcaggactgggtcgggctggtgctcaagtgcggcgagatcaacctgcgggccatggagttactggatgccggcaacaccggcagctacggccatccggtacccaccgaggtgcctctgggcgccaaggccggcaaggcgatcctggtttccgggcacgacctcaaggatctggagatgctgctcaagcagaccgaaggcaaggggatcaatatttacacccatggcgaaatgctgccggcccacggttatcccgagcttaaaaaatatccccatttctatggccattacggcaccgcctggcagaaccagcataaggagttcggcgagttccccggcgccatcctgatgaccaccaactgcatccagaaaccgcaggagtcctacaagggcaacatcttcaccaccggtctggtgggctggccggcagtggcccatgtggacgaccatggctgcccgtcactgctggacaaggtcaaaagcgcggtgggcctcaattatgccggccagggcaaggatttcacgccggtgatcaagaaggcccaggagttgccgggctttgccgccgacaccgacaagggcaaggtgatggtcggttttggccgcaacgccgtaatgggggtggccgacaaggtaatcgaggcggtcaagggcaaggatatccgccacttcttcctggtggccggttgcgacggtgccaagccgggccgcaactactacaccgagtttgtcgagaaggtacccggtgattgcgtggtactgaccctggcctgcggcaagttccgcttctttgataaggacctgggcgacattggcggcattccgcgactgctcgacgtcgggcagtgcaacgacgcctattcggcaatccagatcgccgtggcgctctcccaggcgtttgaatgcgaggtcaacgacctgccgctctccctggtgctctcctggtacgagcagaaggcggtggcgatcctgctgaccctgctccatctggggatcaaggatatccgcctgggacccagcctgccggcctttgtgacccccaatgtgctcaatgtgctggtggagaatttcgacatcaagccgatcagcaccccggatgaggatttgaaggctattttggggtga

SEQ ID NO: 1772 - protein, 564 aa, delta proteobacterium MLMS-1
MFCYQCEQTAKGEGCKTIGVCGKKPEVAALQDLLIYALQGLSLVAVAGRKVGVNDGEVNLFTCEAVFSTLTNVDFDPERFVALIKRTVSLREALLPKVQAAGGQVDSSVAAVTFTPAADQAEMVKQGEEIDMKNSADDDADIQSLKHILLFGLKGVAAYADHAKILGQEDDQVYAFIQEGLVNLLRRDMGLQDWVGLVLKCGEINLRAMELLDAGNTGSYGHPVPTEVPLGAKAGKAILVSGHDLKDLEMLLKQTEGKGINIYTHGEMLPAHGYPELKKYPHFYGHYGTAWQNQHKEFGEFPGAILMTTNCIQKPQESYKGNIFTTGLVGWPAVAHVDDHGCPSLLDKVKSAVGLNYAGQGKDFTPVIKKAQELPGFAADTDKGKVMVGFGRNAVMGVADKVIEAVKGKDIRHFFLVAGCDGAKPGRNYYTEFVEKVPGDCVVLTLACGKFRFFDKDLGDIGGIPRLLDVGQCNDAYSAIQIAVALSQAFECEVNDLPLSLVLSWYEQKAVAILLTLLHLGIKDIRLGPSLPAFVTPNVLNVLVENFDIKPISTPDEDLKAILG

SEQ ID NO: 1773 - DNA, 1695 bp, delta proteobacterium MLMS-1
  CDS (1)..(1695): transl_table=11
atgttttgttatcaatgtgagcagacggccaagggcgagggttgcaagaccataggggtttgcggcaagaaaccggaagtggcggccctgcaggacttgctgatttatgcgatacaggggctgtccctggtggcggtggcaggtcgcaaggtgggagtcaacgacgaggaagtgaaccttttcacctgtgaggcggtgttttccaccttaaccaatgtcgatttcgacccggagcgctttgtcgccctgattaaacggactgtcagcctgcgcgaggccctgttgcccaaagtgcaggccgccggtggccaggtggatagcagcgtcgccgccgttacctttacccccgccgccgaccaggccgaaatggtcaagcagggtgaagagatcgacatgaagaactccgccgacgatgatgccgatatccagtcgctcaagcatatcctgcttttcggccttaagggcgtggccgcctacgccgaccatgccaagatcctgggccaggaggacgaccaggtctacgcctttatccaggagggcctggtcaacctgctgcgccaggacatggggctgcaggactgggtcgggctggtgctcaagtgcggcgagatcaacctgcgggccatggagttactggatgccggcaacaccggcagctacggccatccggtacccaccgaggtgcctctgggcgccaaagccggcaaggcgatcctggtttccgggcacgacctcaaggatctggagatgctgctcaagcagaccgaaggcaaggggatcaatatttacacccatggcgaaatgctgccggcccacggttatcccgagcttaaaaaatatccccatttctacggccattacggcaccgcctggcagaaccagcataaggagttcggcgagttccccggcgccatcctgatgaccaccaactgcatccagaaaccgcaggagtcctacaaaggcaacatcttcaccaccggtctggtgggctggccggcggtggcccatgtggacgaccatggctgcccgtcgctgctggacaaggtcaaaagcgcggtgggcctcaattatgccggccagggcaaggacttcacgccggtgatcaaaaaagcccaggagttgccgggttttgccgccgacaacgacaagggcaaggtgatggtcggttttggccgcaacgccgtaatgggggtggccgacaaggtaatcgaagcggtcaagggcaaggatatccgccatttcttcctggtggccggttgcgacggtgccaagccgggccgcaactactacaccgagtttgtcgagaaggtacccagtgattgcgtggtactgaccctggcctgcggcaagttccgcttcttcgataaggacctgggcgacattggcggcatcccgcgactgctcgatgtcgggcagtgcaacgacgcctattcggcaatccagatcgccgtggcgctctcccaggcgtttgaatgcggggtcaacgacctgccgctctccctggtgctctcctggtacgagcagaaggcggtggcgatcctgctgaccctgctccatctggggatcaaggatatccgtctgggacccagcctgccggcctttgtgacccccaacgtgctcaatgtgctggtggagaatttcgacatcaagccgatcagcaccccggatgaggatttgaaggctattttggggtaa

SEQ ID NO: 1774 - protein, 564 aa, delta proteobacterium MLMS-1
MFCYQCEQTAKGEGCKTIGVCGKKPEVAALQDLLIYAIQGLSLVAVAGRKVGVNDEEVNLFTCEAVFSTLTNVDFDPERFVALIKRTVSLREALLPKVQAAGGQVDSSVAAVTFTPAADQAEMVKQGEEIDMKNSADDDADIQSLKHILLFGLKGVAAYADHAKILGQEDDQVYAFIQEGLVNLLRQDMGLQDWVGLVLKCGEINLRAMELLDAGNTGSYGHPVPTEVPLGAKAGKAILVSGHDLKDLEMLLKQTEGKGINIYTHGEMLPAHGYPELKKYPHFYGHYGTAWQNQHKEFGEFPGAILMTTNCIQKPQESYKGNIFTTGLVGWPAVAHVDDHGCPSLLDKVKSAVGLNYAGQGKDFTPVIKKAQELPGFAADNDKGKVMVGFGRNAVMGVADKVIEAVKGKDIRHFFLVAGCDGAKPGRNYYTEFVEKVPSDCVVLTLACGKFRFFDKDLGDIGGIPRLLDVGQCNDAYSAIQIAVALSQAFECGVNDLPLSLVLSWYEQKAVAILLTLLHLGIKDIRLGPSLPAFVTPNVLNVLVENFDIKPISTPDEDLKAILG

SEQ ID NO: 1775 - DNA, 1695 bp, delta proteobacterium MLMS-1
  CDS (1)..(1695): transl_table=11
atgttttgttatcaatgtgagcagacggccaagggcgagggttgcaagaccataggagtttgcggcaagaaaccggaagtggcggccctgcaggacttgctgatttatgcgctgcaggggctgtccctggtggcggtggcaggtcgcaaggtgggagtcaacgacgaggaagttaaccttttcacctgtgaggcggtgttttccaccttaaccaatgtcgatttcgacccggaacgctttgtcgccctgatcaaacggactgtcagcctgcgagaggccctgttgcccaaggtgcaggccgccggtggccaggtggatagcagcgtcgccgccgttacctttacccccgccgccgaccaggccgaaatggtcaagcagggtgaagagatcgacatgaagaactccgccgacgatgatgccgatatccagtcgctcaagcatatcctgcttttcggcctcaagggcgtggccgcctacgccgaccatgccaagatcctgggccaggaggacgaccaggtctacgcctttatccaggagggcctggtcaacctgctgcgccgggacatggggctgcaggactgggtcgggctggtgctcaagtgcggcgagatcaacctgcgggccatggaattactggatgccggcaacaccggcagctacggccatccggtacccaccgaggtgcctctgggcgccaaagccggcaaggcgatcctggtttccgggcacgacctcaaggatctggagatgctgctcaagcagaccgaaggcaaggggatcaatatttacacccatggcgaaatgctgccggcccacggttatcccgagcttaaaaaatatccccatttctacggccattacggcaccgcctggcagaaccagcataaggagttcggcgagttccccggcgccatcctgatgaccaccaactgcatccagaaaccgcaggagtcctacaagggcaacatcttcaccaccggtctggtgggctggccggcggtggcccatgtggacgaccatggctgcccgtccctgctggacaaggtcaaaagcgcggtgggcctcaattatgccggccagggcaaggacttcacgccggtgatcaaaaaagcccaggagttgccgggttttgccgccgacaacgacaagggcaaggtgatggtcggttttggccgcaacgccgtaatgggggtggccgacaaggtaatcgaagcggtcaagggcaaggatatccgccacttcttcctggtggccggttgcgacggtgccaagccgggccgcaactactacaccgagtttgtcgagaaggtacccagtgattgcgtggtactgaccctggcctgcggcaagttccgcttctttgataaggacctgggcgacattggcggcatcccgcgactgctcgatgtcgggcagtgcaacgacgcctattcggcgatccagatcgccgtggcgctctcccaggcgtttgaatgcggggtcaacgacctgccgctctccctggtgctctcctggtacgagcagaaggcggtggcgatcctgctgaccctgctccatctggggatcaaggatatccgtttaggacccagcctgccggcctttgtgacccccaacgtgctcaatgtgctggtggagaatttcgacatcaagccgatcagcaccccggatgaggatttgaaggctattttggggtaa

SEQ ID NO: 1776 - protein, 564 aa, delta proteobacterium MLMS-1
MFCYQCEQTAKGEGCKTIGVCGKKPEVAALQDLLIYALQGLSLVAVAGRKVGVNDEEVNLFTCEAVFSTLTNVDFDPERFVALIKRTVSLREALLPKVQAAGGQVDSSVAAVTFTPAADQAEMVKQGEEIDMKNSADDDADIQSLKHILLFGLKGVAAYADHAKILGQEDDQVYAFIQEGLVNLLRRDMGLQDWVGLVLKCGEINLRAMELLDAGNTGSYGHPVPTEVPLGAKAGKAILVSGHDLKDLEMLLKQTEGKGINIYTHGEMLPAHGYPELKKYPHFYGHYGTAWQNQHKEFGEFPGAILMTTNCIQKPQESYKGNIFTTGLVGWPAVAHVDDHGCPSLLDKVKSAVGLNYAGQGKDFTPVIKKAQELPGFAADNDKGKVMVGFGRNAVMGVADKVIEAVKGKDIRHFFLVAGCDGAKPGRNYYTEFVEKVPSDCVVLTLACGKFRFFDKDLGDIGGIPRLLDVGQCNDAYSAIQIAVALSQAFECGVNDLPLSLVLSWYEQKAVAILLTLLHLGIKDIRLGPSLPAFVTPNVLNVLVENFDIKPISTPDEDLKAILG

SEQ ID NO: 1777 - DNA, 1650 bp, Desulfitobacterium hafniense DCB-2
  CDS (1)..(1650): transl_table=11
atgagtatgttctgttttcaatgtcaggaaaccgctaaaggaaccggctgtaccatcaaaggagtatgtggaaagactgcagatgtcgctaacctgcaggatcttctgctctatgtcatgaaaggaatcgccatcaacagcctgcaagcccgtgaactggggattgtccgccaagatgtagacaaattcgttatggaaggcttattcgccaccattaccaacgctaactttgataacgctcgtttcgtagctctggttcgcgaaggtcttgctttacgcgacagcttaaaagccgacatcgtcaaagccgggggagttctgcccgctaatcttcatgattcagcgacctggactgcagattctgcggaagaatttgagcaaaaggcagcacaagtaggtatcttagccactgaaaacgaagatgtacgctcccttcgtgaacttttaatctatggacttaaaggaatggcagcttacgcagagcatgccttcgctcttggctatgaagataacagcatctttgcctttatgatgaaaggcctggctgctactaccgatgacagcctttcggcagaccaactggtcgctctggtactcgaagctggaaaatacggcgtcgatgtcatggctcttctggataaagccaacacaacttcttacggcaaccccgaaatcaccaaggtcaatatcggcgtacgcaataaccctgccatcctcatcagcggccatgatttgagagacttggaagacctcctcaagcaaaccgaaggaaccggcgtagatgtttatacccacggcgaaatgcttcccgctcactactatccggccttcaaaaagtatgctcactttgtgggtaactatggcaatgcctggtggaaacaagacaaagaatttgattcctttaacggagctattcttctcaccaccaactgtttagtaccccccaaggattcctataaagaccgtctcttcaccaccagtgtcgttggctacgaaggtgtaaaacacatccctgcccgtgaagcgggcaaagtcaaagacttctcggcagtgatcgaattagccaaaaccctgccggcacctaccgagatcgaaaccggagaaatcgtcggcggctttgctcataatcaagtctttgccgtagctgataaagtggttgaagctgtaaaatccggagctgtaaaacgcttcttcgtcatggccggttgtgacggacggatgaagagccgcgattactacacagaattcgccaaagcccttccccaagacaccatcatcctcactgcaggttgtgccaaatataaatacaacaaactggcactgggagacatcggtggtattcccagagtcctggatgccggacaatgcaacgactcctactccctggccgttattgctcttaagcttaaagaagtcttcggccttgacgatgtcaaccagcttcctatctcctacaacattgcctggtatgagcaaaaagcagtcatcgtactcctggcgctcctctacctgggcgtgaagaatatccacttaggacccactttgcctggattcctctctcccaacgtagccaaagttctggttgagaacttcggaatcgccggtatcactaccgtcgaagacgacgtcaacctcttcatgggtgcataa

SEQ ID NO: 1778 - protein, 549 aa, Desulfitobacterium hafniense DCB-2
MSMFCFQCQETAKGTGCTIKGVCGKTADVANLQDLLLYVMKGIAINSLQARELGIVRQDVDKFVMEGLFATITNANFDNARFVALVREGLALRDSLKADIVKAGGVLPANLHDSATWTADSAEEFEQKAAQVGILATENEDVRSLRELLIYGLKGMAAYAEHAFALGYEDNSIFAFMMKGLAATTDDSLSADQLVALVLEAGKYGVDVMALLDKANTTSYGNPEITKVNIGVRNNPAILISGHDLRDLEDLLKQTEGTGVDVYTHGEMLPAHYYPAFKKYAHFVGNYGNAWWKQDKEFDSFNGAILLTTNCLVPPKDSYKDRLFTTSVVGYEGVKHIPAREAGKVKDFSAVIELAKTLPAPTEIETGEIVGGFAHNQVFAVADKVVEAVKSGAVKRFFVMAGCDGRMKSRDYYTEFAKALPQDTIILTAGCAKYKYNKLALGDIGGIPRVLDAGQCNDSYSLAVIALKLKEVFGLDDVNQLPISYNIAWYEQKAVIVLLALLYLGVKNIHLGPTLPGFLSPNVAKVLVENFGIAGITTVEDDVNLFMGA

SEQ ID NO: 1779 - DNA, 1662 bp, Vibrio sp. Ex25
  CDS (1)..(1662): transl_table=11
atgttctgtattcaatgtgaacagacaattcaaacccctgctgttaaaggttgttcttttgcacaaggcatgtgtggcaaaacttctgaagtatcagacctacaagacgtgttggtttacacactgcaaggggtttctttttgggcatcaaaagcacttgaattcaacatcattaacgatgaaatcaaccaatgggcaccaaaagcatttttctctacattgacgaacgtaaacttcgaccctgaacgtgtcctagagctgacttctcaagcagcaacgtacaaagcattgctaaaagagcaagtgatgtcggcagcaacgcttgccgataccgaagtcgctgacattcctgcggttgctcactttgagctaccaaacagcgcagaagcaatcttagcttttgctccgcaagtcgcggttaaccgtggtaaagaccaagtacatgaagatgttattggcctacgcctactttgcctatacggccttaaaggtgcagccgcgtacatggagcacgcacgtgttcttgagcaaaccaacaacgatatctatgccgaataccatgaaatcatggcgtggttgggcacagatcctgaagatctcggcgaactacttgattgctcaatgcgcattggtctgatgaactacaaagtgatggaaatgctcgaccaaggtgaaacaacgaccttcggccatccagaaccaaccacggtgaacgtcaagccagtaaaaggtaaatgtattcttgtttctggccatgatttgcatgacctagaaaaaatcctgcaacagaccgaaggcaaaggcattaacgtttacaccaacggtgaaatgctgcctgcacacggctaccctgagctgaagaaatactctcatcttgtcggtaactacggcagcgcatggcaaaaccaacagaaagagttcgcaaacttccctggcgcaatcgtaatgacgtcgaactgcttgttgaatccaaatgtgggtcaatacgcagaccgtctattcacccgtagtattgttggctggcctggtgtggctcacatcgaaggcgatgattttagccaagtgattgaatgtgctctagcgcaagacggtttccaacacgatgaaatcgaacaccacatcacggttggttttggtcgcaatgcactgatgaacgccgcccctgcggttatcgaccaagtgaagcaaggcaacatcaaacacttcttcctagtcggcggttgtgatggtgataaagcggaacgcagctactacaccgattttacggctgaagcgccagaagatacgctaatcctgaccttggcgtgtggtaagttccgcttcaacaagaatacgttcggcgatatcaacggtatccctcgcctattggatgtgggccaatgtaacgatgcttactctgcaatccagcttgcacttgcactggcgcaagagtttgactgtgacatcaatgaactgccactcacgcttgtactttcttggttcgagcaaaaagcgatcgttatcttgctaacgctatttgcattgggcgtgaaaggcatttacacaggccctactgcaccggcattcctaacgccaaacctaatcgcgatcatccaagagaagttcgatatgcgcagtattggcaatgttcaggatgatctaaaagccatcctagcagcttaa

SEQ ID NO: 1780 - protein, 553 aa, Vibrio sp. Ex25
MFCIQCEQTIQTPAVKGCSFAQGMCGKTSEVSDLQDVLVYTLQGVSFWASKALEFNIINDEINQWAPKAFFSTLTNVNFDPERVLELTSQAATYKALLKEQVMSAATLADTEVADIPAVAHFELPNSAEAILAFAPQVAVNRGKDQVHEDVIGLRLLCLYGLKGAAAYMEHARVLEQTNNDIYAEYHEIMAWLGTDPEDLGELLDCSMRIGLMNYKVMEMLDQGETTTFGHPEPTTVNVKPVKGKCILVSGHDLHDLEKILQQTEGKGINVYTNGEMLPAHGYPELKKYSHLVGNYGSAWQNQQKEFANFPGAIVMTSNCLLNPNVGQYADRLFTRSIVGWPGVAHIEGDDFSQVIECALAQDGFQHDEIEHHITVGFGRNALMNAAPAVIDQVKQGNIKHFFLVGGCDGDKAERSYYTDFTAEAPEDTLILTLACGKFRFNKNTFGDINGIPRLLDVGQCNDAYSAIQLALALAQEFDCDINELPLTLVLSWFEQKAIVILLTLFALGVKGIYTGPTAPAFLTPNLIAIIQEKFDMRSIGNVQDDLKAILAA

SEQ ID NO: 1781 - DNA, 1647 bp, Candidatus Desulfococcus oleovorans Hxd3
  CDS (1)..(1647): transl_table=11
atgttttgttttcaatgtcaggaaacagccaaaaaccagggctgtacagtcaagggcgtgtgcggcaaacccgaagagaccgccgatcttcaggacctgctgatttacgtgtgcaaggggatcgcgatttacggtgaagcgctgaatgccgccggcactctggatcgcgaagcggcccatttcatctgccgcgccctgtttaccaccatcaccaacgtggcctgggatgatgacgtgctcgtcgaccggatcaaagaaggcctggcggtgcgggatgccgtaaaggcaaaggcgggagaggccgtgtccggctcgcttcccgactgcgccacctgggcatcggaagacaaggcggccatcatggccaaggccctgtccgacgaggtgcgcatcaccaccatggccaatgaagacgtgcgctccttgcgggagctgctgatcctggggtgcaaaggggtcgccgcctataccgaccatgccgccattctggggtatgaaaaggacgatatttacgcctttctcatggaagccctggcctccaccacaaaagagctttccgtggacgatatgatcggcctggtgatgaaggccggcgaaaccgcagtggctgccatggcccttctggacgaggccaacaccgccacctacggccacccggaaattacggaagtcaatatcggcgtgggcaaaaaccccggcattctgatctccggccatgacctgaaagacatggaagagctgctccgccagaccgagggcacgggcgtggatgtctacacccacggtgaaatgctgccggccaactactacccggctttcaagaaatacagccattttatcggcaactacggcggctcctggtggcaccagaacaaggattttgagtcctttaacggcgccattcttctgaccaccaactgcctgattcccattaagggcgacaacacctacaaggaccggctctttaccacgggcgtggtcaactatcccggcgcggcccacatcggggaccggccggacggcggggccaaggacttttccccgattattgagcgggccaaaacgtgcgcgccccccacggagatcgaaaccggcaccattgtgggcgggtttgcccaccaccaggttctggccctggccgacaaggtcgtggacgcggtcaagtccggcgccatcaaacggttcgtggtcatggccggatgcgacggccgcatgaagtccagaagctattttaccgaggtggccgaagccctgcccaaggacacggtgatcctcaccgccgggtgcgcaaagtaccggtacaacaagctgaacctgggggacatcggcggcattccccgggtcctggacgcgggccagtgcaacgactcctactccctggccgtcatcgccctgaagctcaaggaggtgttcgggctggccgacatcaacgacctgcccatctcctacgacatcgcctggtacgagcagaaggccgtggccgtgctgctggccctgctttttctgggcgtcaagggcattcgcctggggcccaccctgccggcctttctctcacccaccgtggccggggtcctggtggacaagttcgacatcaagcccatcggtacggttgccgatgatgtggcggccatgatggccggcaagtaa

SEQ ID NO: 1782 - protein, 548 aa, Candidatus Desulfococcus oleovorans Hxd3
MFCFQCQETAKNQGCTVKGVCGKPEETADLQDLLIYVCKGIAIYGEALNAAGTLDREAAHFICRALFTTITNVAWDDDVLVDRIKEGLAVRDAVKAKAGEAVSGSLPDCATWASEDKAAIMAKALSDEVRITTMANEDVRSLRELLILGCKGVAAYTDHAAILGYEKDDIYAFLMEALASTTKELSVDDMIGLVMKAGETAVAAMALLDEANTATYGHPEITEVNIGVGKNPGILISGHDLKDMEELLRQTEGTGVDVYTHGEMLPANYYPAFKKYSHFIGNYGGSWWHQNKDFESFNGAILLTTNCLIPIKGDNTYKDRLFTTGVVNYPGAAHIGDRPDGGAKDFSPIIERAKTCAPPTEIETGTIVGGFAHHQVLALADKVVDAVKSGAIKRFVVMAGCDGRMKSRSYFTEVAEALPKDTVILTAGCAKYRYNKLNLGDIGGIPRVLDAGQCNDSYSLAVIALKLKEVFGLADINDLPISYDIAWYEQKAVAVLLALLFLGVKGIRLGPTLPAFLSPTVAGVLVDKFDIKPIGTVADDVAAMMAGK

SEQ ID NO: 1783 - DNA, 1650 bp, Arthrospira platensis FACHB341
  CDS (1)..(1650): transl_table=11
atgttttgtgaacaatgcgaacaaactgccagcggtcaaggttgccaccagtggggcgcttgtggtaaaggaccggatgtaaatgcggttcaagacctattgatttactgtctgcgtggtattgcgcctgtggctttgaaggctaaggaattgggcattgatacccatgctgtggatgtgttttgctgtgagtcgatgttcgccacgatgacgaatgttaactttaaccgtaaacgcttttacagctatatccgtgaggcgatcgcccaacgggaaaaactcaaaaccgaaattcaacagatgagcgatcgccccatcagttggtctgtagctgctacctatcaaccagactggactgatagtttagtagcccagggggaggaagtttcccgtaactttattgccgactctagtcaagacatcgatatcttctccctcaaacttaccgtcctctacggtttgaagggcttggtttcctacagtttccacgcccaagaacttggtcaggaagacgatcgcatttatagtttctgtcaccaagccctcgccgccttggaagaacctagtctcggtttagaagattgggttaatctagccatgaaagtcggggaaatgaacctgttggctatggaacttctcgacgcgggacacactaaccattatggtcatcctatccctaccgttgttcccctgaatgcaaaggccgggaaagccattttggtctctggtcacgacattaaacaactcgaagccatccttcaacaaacagccaatactggtattaatgtttacacccacggcgagttactacccgcccatggctacccagtccttaaacaaaaatatccccacctttacggtcactatggcacagcttggcaaaatcaaaccaaggatttcgctaagtttcccggtgcgatcgtcatcaccactaactgtttgatgcctccccacgaacactatgaggataaattatttaccctcggtccggtgggatatcctgacatcaactatctcgaagatagggcaaatcttaccccagattttagccccgccattcacaaagccctggctttagctgggtttgcagaagatgaaccaccccgtcaggtaaaaactggcttcgcccgtaatgcggtattaaatgttagcgaccaggtgattgaggcggttaaacaaggcaaaattcgccatttcttcctagtcggaggttgtgatggggctaaacccgatcgcaattattataccgaatttgtcgatcaggttccctcagattgtgtggtgttaaccctcgcctgtggaaaattccgcttttttgataaggaaatgggggaaattggtaacattcctcggctgatggatgtgggacagtgcaatgatgcctattcggctattcagatcgccctaggactcgcccaagcctttgatatcggagttaatgaacttcctctatctatgattttgtcttggtatgaacagaaggctgtggcggttctgctgacactattatatttgggtatcaaagatatccgtttgggtccgactttaccggctttcatttcccctaatgtcttcgctatcctatcggcaaaatacaacctacaggctattaccactcccgaagctgatttagccgcctgtttaaactag

SEQ ID NO: 1784 - protein, 549 aa, Arthrospira platensis FACHB341
MFCEQCEQTASGQGCHQWGACGKGPDVNAVQDLLIYCLRGIAPVALKAKELGIDTHAVDVFCCESMFATMTNVNFNRKRFYSYIREAIAQREKLKTEIQQMSDRPISWSVAATYQPDWTDSLVAQGEEVSRNFIADSSQDIDIFSLKLTVLYGLKGLVSYSFHAQELGQEDDRIYSFCHQALAALEEPSLGLEDWVNLAMKVGEMNLLAMELLDAGHTNHYGHPIPTVVPLNAKAGKAILVSGHDIKQLEAILQQTANTGINVYTHGELLPAHGYPVLKQKYPHLYGHYGTAWQNQTKDFAKFPGAIVITTNCLMPPHEHYEDKLFTLGPVGYPDINYLEDRANLTPDFSPAIHKALALAGFAEDEPPRQVKTGFARNAVLNVSDQVIEAVKQGKIRHFFLVGGCDGAKPDRNYYTEFVDQVPSDCVVLTLACGKFRFFDKEMGEIGNIPRLMDVGQCNDAYSAIQIALGLAQAFDIGVNELPLSMILSWYEQKAVAVLLTLLYLGIKDIRLGPTLPAFISPNVFAILSAKYNLQAITTPEADLAACLN

SEQ ID NO: 1785 - DNA, 1641 bp, Rhodobacter capsulatus
  CDS (1)..(1641): transl_table=11
atgtattgcatccaatgcgaacagacgcttcacaccgcgaccggcaccggctgccgctttgcccggggcgattgcggcaagacggctgccatttccgatcagcaagatgcgctggttgcggcgctgctggcggtgtcgagccatgccgatgccgcgcgcaaggttgggctgatcgatgccgaggtcgatgccttcgtgccgcaggcgctgtttgccacgctgaccaatgtcaatttcgaccccgagcggctggcgggctatatccgcaaggcgcaggagttgcgcaaccggctgcagctggccttggcgggcaagccgctggcgctgcccgctttggccgatgccgactggcccttcgcggcggcgcaacaggccgaggcgggcaagatcgtcgcgctcaaccgcgatgcggcgcggatcggcgaggatgtgctggggctgcggcttttgtgtctttacgggctcaaggggattgcggcctatatggaacatgcccgggtgctggggcagaccgatacgcaggtggcggcgggctttcatgcccacatggcctatcttgcgagcgaacccacggatgcgaaaggactttttgccgaggcgctggcgatcggcacgctgaatttccgggtgatggagatgctcgatgcaggcgccaccggcacgttcggcgatccgcaaccgacgccggtgaaccgccgtccggtggcgggcaaggcaattttggtctcgggtcatgacctgcatgacctgttgcgcattcttgagcagaccgcggggcgcggcatcaacgtctatactcatggcgagatgctgcccgcgcatggctatccggcctttcatgcccatccgcatctgatcggcaattacggcagcgcctggcaaaaccagcaggcggaatttgcagcctttccgggggccatcgtgatgacctcgaactgtctgatcgacccgcgcacgggggcctatcaggaccggatcttcacccgctcgatcgtcggttggccgggggtgcgccatatcgagggcgaggatttcgccgaggtcatcgcctgtgccgaggccctgcccgggttcgccgcgaccgaggcgccggtgactcaactgaccggttttggccgcaatgcgctgatgacggcggcgcctgcggtgatcgagcgtgtcaaggtgggcaagatccggcatttctacctgatcggcggctgtgacggtgctcgggccgagcgggcctattacgccgatctggcgcggatgctgccgcaagacacggtggtgctgacgctgggctgcggcaagttccggctggatggcatcgatttcggcgcggtggacgggctgccgcggctgcttgatgtgggccaatgcaacgatgcctatgccgcgatccgtctggcgctggcgctggccgaggctttcgattgcggcgtcaacgatctgcccttgacgctggtgctgtcgtggttcgagcaaaaggcgatcgtgatcttgctgacgctcctggcgctgggggtcaaggatatccgcgtcgggccgaccgcgcccggttttctcacgccaaacctgatcgcgaccttgaatgcgcaattcggactgcggctgatctcgacgcccgaggaaacgatggccgaaacgcttagcgcataa

SEQ ID NO: 1786 - protein, 546 aa, Rhodobacter capsulatus
MYCIQCEQTLHTATGTGCRFARGDCGKTAAISDQQDALVAALLAVSSHADAARKVGLIDAEVDAFVPQALFATLTNVNFDPERLAGYIRKAQELRNRLQLALAGKPLALPALADADWPFAAAQQAEAGKIVALNRDAARIGEDVLGLRLLCLYGLKGIAAYMEHARVLGQTDTQVAAGFHAHMAYLASEPTDAKGLFAEALAIGTLNFRVMEMLDAGATGTFGDPQPTPVNRRPVAGKAILVSGHDLHDLLRILEQTAGRGINVYTHGEMLPAHGYPAFHAHPHLIGNYGSAWQNQQAEFAAFPGAIVMTSNCLIDPRTGAYQDRIFTRSIVGWPGVRHIEGEDFAEVIACAEALPGFAATEAPVTQLTGFGRNALMTAAPAVIERVKVGKIRHFYLIGGCDGARAERAYYADLARMLPQDTVVLTLGCGKFRLDGIDFGAVDGLPRLLDVGQCNDAYAAIRLALALAEAFDCGVNDLPLTLVLSWFEQKAIVILLTLLALGVKDIRVGPTAPGFLTPNLIATLNAQFGLRLISTPEETMAETLSA

SEQ ID NO: 1787 - DNA, 1644 bp, Clostridium perfringens
  CDS (1)..(1644): transl_table=11
atgagtatgttttgttctcaatgtcaagaaacagcaggatgcaaaggctgtactgtaagaggagtttgtggaaaaactgaagatgtagcaaaaatacaagaccttttattttttgttactaaaggattagctacagtagctaatgaaggaagaaaagtagggatagtagataaaaaagtaaacagaatgataatagataacttatttattactattactaatgcaaactttgattttaaagcaatagaaaaaagagttaaagatactttagtagcaagagaagaattaaaagaaagagtacaagctaagggtggaaatccaattggatcagacttcaaaggatgtgcaacttggactgctacaactagtgaagaaatgatggaaaaagcttcacaagtaggagttttagctacagaaaatgaagatataagaagcttaagagaacttattatgtatggattaaaaggattagcagcatacatggagcatgctatgaatttaggacatgataaagaagaagttcatgcatttatggcagaaactttagttaaaatattagatgattcattaagcgcagatgaattaactgctttagcattagaaacaggaaaattcggtgttgatggaatggcattattagatgaagctaacacttcaacttatggtcatccagaaataacaaaagttaattatggagttagaaataacccaggaatattaatatcaggacatgatttaaaagacttagaaatgttattagaacaaaccgaaggaactggagtagatgtttatactcatggagaaatgttaccaggacacttttatcccaaatttaagaaatatctccctcccggaaattatggtaatgcaggttggtcccaaaataaagagttcgcatcatttaatggcccaatattaatgacaacctgtatacccccagttcaagattcatatagaggaagaatatttacaacaggcgctgtaggatatgaaggatgtattcatataacagcagatgaaaatggatacaaagatttctcacaaataatagagttagctaagacttgcaaagctccaacagagattgaaacaggagaaatcgtaggtggatttgctcataatcaagtacttgctttagctgaccaagtagttgatgctgttaaatcaggtgcaataagaagattcttcgtaatggctgggtgtgatggaagagctaaatcaagagattactatagagaatttgctgaaaaattaccaaaggacactgttatattaacagctggatgtgctaaatataaatataataagttaccacttggagatatcaatggaattccaagagttttagatgcaggacaatgtaatgattcatactcattagttgtaatagctttaaaacttgctgaagtatttggaacagatagtgtaaatgaattaccaataagctacaacatagcatggtatgaacaaaaagctgtaatagtattattatcattattacacttaggtgttaaaaacattcatttaggaccaactttaccagcattcttatcaccaaacgtagctaaagttttagttgaaaactttggaattggtggaattacaaatgtagaagatgatatgaaaatgttcttaggagaataa

SEQ ID NO: 1788 - protein, 547 aa, Clostridium perfringens
MSMFCSQCQETAGCKGCTVRGVCGKTEDVAKIQDLLFFVTKGLATVANEGRKVGIVDKKVNRMIIDNLFITITNANFDFKAIEKRVKDTLVAREELKERVQAKGGNPIGSDFKGCATWTATTSEEMMEKASQVGVLATENEDIRSLRELIMYGLKGLAAYMEHAMNLGHDKEEVHAFMAETLVKILDDSLSADELTALALETGKFGVDGMALLDEANTSTYGHPEITKVNYGVRNNPGILISGHDLKDLEMLLEQTEGTGVDVYTHGEMLPGHFYPKFKKYLPPGNYGNAGWSQNKEFASFNGPILMTTCIPPVQDSYRGRIFTTGAVGYEGCIHITADENGYKDFSQIIELAKTCKAPTEIETGEIVGGFAHNQVLALADQVVDAVKSGAIRRFFVMAGCDGRAKSRDYYREFAEKLPKDTVILTAGCAKYKYNKLPLGDINGIPRVLDAGQCNDSYSLVVIALKLAEVFGTDSVNELPISYNIAWYEQKAVIVLLSLLHLGVKNIHLGPTLPAFLSPNVAKVLVENFGIGGITNVEDDMKMFLGE

SEQ ID NO: 1789 - DNA, 1593 bp, Clostridium acetobutylicum
  CDS (1)..(1593): transl_table=11
atgagtatgttttgttaccagtgtcaggaagcagcaggctgcaagggttgtacagtaagaggtgtatgtggaaagactgaagatttagcgaaaaaacaagatttattaatatatacattaaaggttgtttcattatacaatgttgaggcaagaaaattaaatttagtaaataaagaaatagataattatatagttgatagtctttttgcaacaataacaaatgcaaattttgatgaaaatatatttactgagagaatagaaaaaggaattaaatataaagaagaattgaagaaacaaatatcagcagcaggaggaaatgtaaatttaaacgaaaaaactgaagctgtaggagttctttcaactgaaaatgaagatataagatctttaagagaattattaacttatggaatcaagggtatggctgcatacttaaagcatgctcgtaacttaagctacgaagatagcaatatacaaggctttatgtcaaaagctttggctgcaacattagatgatactttaggtgcagacgaattagttgccttagctttagagtgtggaaagtatggagtagatgcaatggcacttttagataaagctaatacagaaacttacggaaatcctgaaataacaaaggttaatataggaactaggaataatccaggaatattaataagtggacatgacttaaaggatatagaggagcttttaaagcagacagagggaactggagtagatgtttatactcacagcgaaatgcttccagcaaactactatccagcatttaagaaatattcacactttgtaggaaactacggaaatgcttggtggaaacaaaatgaagagtttgaaagctttaatggaccaatacttatgactacaaactgcatagttcctccaaaagcttcatatatagatagaatgtatacaacaggagtaacaggttatccaggagtaaaacatattgaaaacggtgaaccaaaggatttctcagcaataatagagcatgcgaaaaaatgtgcgccaccaactgaaatagaaaaaggagaaataatcggaggctttgcacacaaccaggttatagctttagcagataaggttgtagaggcagtaaaatcaggagcaattaagagattttatgtaatggcaggttgtgatggaagagcaaaaacaagaaattactatactgactttgctaaagcacttccaaaggatgcagttatacttacagcgggctgcgctaaatacaaatacaataagcttgaccttggagatataggaggtattcctagagtacttgatgctggacaatgcaatgattcatactccttagtagtaatagctcttaagcttaaagaagtatttggacttaatgatataaacgagcttccaatagcatacaacatagcatggtatgagcaaaaagctgtaatagtacttcttgcattattacaccttggtgttaaaaatattcaccttggaccaacacttccagcatttttatccccaaatgttgccaaagttcttgttgataactttggaattggtggaataactaatgtagaagatgatataaaaatgtttgaaaacctataa

SEQ ID NO: 1790 - protein, 530 aa, Clostridium acetobutylicum
MSMFCYQCQEAAGCKGCTVRGVCGKTEDLAKKQDLLIYTLKVVSLYNVEARKLNLVNKEIDNYIVDSLFATITNANFDENIFTERIEKGIKYKEELKKQISAAGGNVNLNEKTEAVGVLSTENEDIRSLRELLTYGIKGMAAYLKHARNLSYEDSNIQGFMSKALAATLDDTLGADELVALALECGKYGVDAMALLDKANTETYGNPEITKVNIGTRNNPGILISGHDLKDIEELLKQTEGTGVDVYTHSEMLPANYYPAFKKYSHFVGNYGNAWWKQNEEFESFNGPILMTTNCIVPPKASYIDRMYTTGVTGYPGVKHIENGEPKDFSAIIEHAKKCAPPTEIEKGEIIGGFAHNQVIALADKVVEAVKSGAIKRFYVMAGCDGRAKTRNYYTDFAKALPKDAVILTAGCAKYKYNKLDLGDIGGIPRVLDAGQCNDSYSLVVIALKLKEVFGLNDINELPIAYNIAWYEQKAVIVLLALLHLGVKNIHLGPTLPAFLSPNVAKVLVDNFGIGGITNVEDDIKMFENL

SEQ ID NO: 1791 - DNA, 1704 bp, Clostridium acetobutylicum
  CDS (1)..(1704): transl_table=11
atgtcaatgttttgttatcaatgtcaagaaactgcaggatgcaaaggatgtacggttaagggcgtttgtggtaaggatgaaagtgtagcaaaagctcaagatttattaatatatgtaactaaaggactagcagtagttagcaatgaaggaatgaaggtaggggttaaagacagcaaggttaataaatatatagtagagaacctatttacaacaataactaatgctaattttgatagagattctattttagatagagtgagagaaactttaagaataagagaagatttaaaggctaaggttgttaaggctggtggaaaagtaggggaagttaaggtaagtggaggtttctttaagaagttatttggaattgcaaaagaagaaatggtaggaccagatgctgcaacttggactgcggacaatgtaatagaatttgatgcgaaagctgaaaaggttggagtgctttcaacagaaaatgaagatataagaagtcttagagaattaattacttatggattaaaaggtttatcagcctacatgaagcatgctatgaacttaaagtatgatgatgaaactgttcatgaatttatggcaaaagcattggcagcaactttagatgacagtttaagcgtagatcaattagttgccttggcacttgaagctggtaagttcggtgtaaatggaatggcgcttcttgacaaagcaaatactgaaacctacggaaatcctgaaataactactgttgatattggagttagaaaaaatccaggaatattgatttcaggacacgatttgagagatttagaaatgttacttgagcaaacagagggaacaggagtagacgtatatactcatggagaaatgcttgctggacaatattatccaaagtttaaaaagtataaaaactttgcagggaattatggtaatgcgtggtggaaacaaaaagaagaatttgagaagtttaatggccctatagtgatgactactaactgtatagttataccaaaggcttcctacaaaaatagactgtttacaacaggagctacaggtatgcctgggtgtcctcatatagaagctaaagctgatggaacaaaggatttctcagaagttataaaaatggctaagaaatgcagtgcacctacagaaatagaaaagggacagatagttggtggatttgcacataatcaagttatagcgcttgcggataaggttgtagctgcagttaaatcgggggctataaagagatttttcgtaatggctggatgtgacggaagagctaattcaagaaattactatacagaatttgctgaaaaattgcctaaggatacagttatattaacagcaggttgtgcgaaatataaatacaacaagcttaacctaggagatatcggtggaattccaagagttttagatgctggacaatgtaatgattcatattccttagttgttatagcacttaaactgcaagaggtatttagattgaagagtgtaaatgagcttcctatatcatataacatagcttggtatgagcaaaaagctgtaatagtattattatcgttattacacttgggagttaaaaatattcatttaggaccaacactaccagcattcctttcaccaaatgtggcaaaggtattagtagataactttggaattggtggaatcactaatgtagaagatgatatgaaaatgtttatgcaaggttaa

SEQ ID NO: 1792 - protein, 567 aa, Clostridium acetobutylicum
MSMFCYQCQETAGCKGCTVKGVCGKDESVAKAQDLLIYVTKGLAVVSNEGMKVGVKDSKVNKYIVENLFTTITNANFDRDSILDRVRETLRIREDLKAKVVKAGGKVGEVKVSGGFFKKLFGIAKEEMVGPDAATWTADNVIEFDAKAEKVGVLSTENEDIRSLRELITYGLKGLSAYMKHAMNLKYDDETVHEFMAKALAATLDDSLSVDQLVALALEAGKFGVNGMALLDKANTETYGNPEITTVDIGVRKNPGILISGHDLRDLEMLLEQTEGTGVDVYTHGEMLAGQYYPKFKKYKNFAGNYGNAWWKQKEEFEKFNGPIVMTTNCIVIPKASYKNRLFTTGATGMPGCPHIEAKADGTKDFSEVIKMAKKCSAPTEIEKGQIVGGFAHNQVIALADKVVAAVKSGAIKRFFVMAGCDGRANSRNYYTEFAEKLPKDTVILTAGCAKYKYNKLNLGDIGGIPRVLDAGQCNDSYSLVVIALKLQEVFRLKSVNELPISYNIAWYEQKAVIVLLSLLHLGVKNIHLGPTLPAFLSPNVAKVLVDNFGIGGITNVEDDMKMFMQG

SEQ ID NO: 1793 - DNA, 1632 bp, Bacteroides thetaiotaomicron
  CDS (1)..(1632): transl_table=11
atgagtatgttctgttatcaatgtcaagagaccgcaatgggtacaggctgtaccttaaaaggagtatgcggaaaaacatccgaagtggctaacctgcaagacctgctgctctttgtagtacgaggaatcgccgtgtacaacgaacatctgcgccgggaaggacatccttctgaagaagcagacaaatttatctacgatgccctgttcatcaccatcactaacgccaattttgacaaagcggccatcatcagaaaaataaaagaaggactacaactgaaaaacgaactcgccagcaaagtaaccattgcaaatgctcccgacgaatgtctttgggatgggaatgaagatgagtttgaagagaaagccaggacagtaggagtacttcgcacacccgacgaagatatccgttcgctgaaagaactggtacactacggactgaaaggtatggcggcttacgttgagcatgcgcataaccttggataccagtcgccggaaatcttcgcctttatgcaaagtgcactggccgagctcacccgcaatgatattacgatggaagaattggttcagcttactttggcaacaggcaagcacggagtttccgccatggcacaactggatgccgccaatacaaacagctacggaaatccggaaatatcggaagtgaatctaggtgtccgcaataatcccggtatccttatcagcggccatgatctgaaagacctcgaagaattgctggaacagaccgaaggaacaggtatagacatttacactcacagtgaaatgctccccgcacattattacccccaactgaaaaaatacaagcatctggcaggaaactacggaaatgcctggtggaaacagaaagaagagtttgaaagtttcaacggaccgatcctgtttaccagtaactgcatcgttcctccgcgtgccaacgcttcttacaaagaccgtatctacatcaccggagcctgcggactggagggagcacactacatccccgaacgcaaagacggaaaaccgaaagatttctccgcactgattgcacatgccaagcaatgtcaaccgccgacggccatcgaaagcggaacgttgatcggaggttttgcccatgcacaggtagtggctttggcggataaggtagtagaagccgtgaaaagcggagcgatccgtaagttcttcgttatggcaggatgtgacggacgtatgaaaagtcgtgaatattataccgaatttgccgagaaacttccgaaagatacagtcatcctgactgccggttgtgctaaatacagatacaacaaactggctttaggtgacattaacggcattccccgcgtattggatgcagggcaatgtaacgacagttactcactggctgtcatcgcactgaaactgaaagaagtattcggattggacgacgtcaacaaacttcctatcgtatataacatcgcatggtacgaacagaaagcggtgatcgtattgctggcattgctggcactgggagtgaagaatattcatctgggacctactcttccggccttcctttcaccaaacgtaaaaaacgtattgatcgaacaattcggaatcggtggcatcagtaccgcagacgaagatattatgaagttcttgtcataa

SEQ ID NO: 1794 - protein, 543 aa, Bacteroides thetaiotaomicron
MSMFCYQCQETAMGTGCTLKGVCGKTSEVANLQDLLLFVVRGIAVYNEHLRREGHPSEEADKFIYDALFITITNANFDKAAIIRKIKEGLQLKNELASKVTIANAPDECLWDGNEDEFEEKARTVGVLRTPDEDIRSLKELVHYGLKGMAAYVEHAHNLGYQSPEIFAFMQSALAELTRNDITMEELVQLTLATGKHGVSAMAQLDAANTNSYGNPEISEVNLGVRNNPGILISGHDLKDLEELLEQTEGTGIDIYTHSEMLPAHYYPQLKKYKHLAGNYGNAWWKQKEEFESFNGPILFTSNCIVPPRANASYKDRIYITGACGLEGAHYIPERKDGKPKDFSALIAHAKQCQPPTAIESGTLIGGFAHAQVVALADKVVEAVKSGAIRKFFVMAGCDGRMKSREYYTEFAEKLPKDTVILTAGCAKYRYNKLALGDINGIPRVLDAGQCNDSYSLAVIALKLKEVFGLDDVNKLPIVYNIAWYEQKAVIVLLALLALGVKNIHLGPTLPAFLSPNVKNVLIEQFGIGGISTADEDIMKFLS

SEQ ID NO: 1795 - DNA, 1620 bp, Chlorobium tepidum
  CDS (1)..(1620): transl_table=11
atgcattgcgaccaatgccaggagagcatcaagggaggctgcaacgtccgtggcgtgtgcggcaaggatgaattgaccgccaaacttcaggatacgctgatctacgccgccgagggcatcgccctgtgtgccgaggggtttgaaggaaagattgacaggaaatacgggcagttcatcagcgagtgcctgttcgtgaccgtcaccaacaccaacttcgacgacgtggccatcgtcgagcagatccggaaagcgctcgccatgcgcgacgaagtcagggcgctcgccggaacgactccggcgcacgacgccgcgaactggagcggcagcaccaaagaggagtttctcgccaaggctgcggcgtgcagcatcgacagtctgagcgcagaccccgatcttcgctcgctcaagagcctcatcctgtatggcatcaagggccttgccgcctacactgaccacgccgcagtgcttggctatcacgacgacgacatctacgctttctacgtcaaaggcttgtccgcgctgaccaaagagttgccagccgacgagctgctcggtctcgtgatggagtgcggcgctaccgccgtaaaggcgatggcactgctcgacaaggccaacaccgagacttacggcaatcccgaaatcaccacggtcaagaccggcgtcgggacccgtccgggtatcctcatctcaggccacgacttgcgcgacatggaagatctgctcaagcagaccgaaggcaccggcgtggatgtctatacccactgcgaaatgctgcccgcgcactactacccagccttcaaaaagtacgaccacttcgtcggaaactacggcaactcgtggtggtcgcaggatcgtgagttcgagagcttcaacggcccgattctgatgacaaccaactgcatcgtaccggtgcgcgaatcctatcgtggccgcatgttcaccaccggcatggcgggctatcctggcctgaaacatattccggcgcgtcccgacggcggcagcaaggacttctcggagatcatcgagctggccaaaacctgcaagcctccgatcgagatcgagaacggcgaaatcgttggcggcttcgctcacacccaggtgctggcgctggccgacaaggtggtcgatgcggtcaagtcgggcgcgatcaggcgcttcgtggtgatggcaggttgcgatggacgccacaactcgcgccagtactacaccgacgtggctgaaacccttccgaaggacacggtcatcctgaccgccggatgcgccaagtaccgctacaacaagttggagcttggcgacatcggtggcattccgcgcgtgctcgacgctggtcagtgcaacgacagctactcgctggccgtgatcgccatgaaacttcaggaggtgttcgggctggagaacatcaacgacctgccaatctcctacgacatcgcctggtacgaacagaaagcggtcaccgtgctgctcgccctgctcttcctcggcgtcaagggcatcaggctcggcccaacactgccggagttcctcaccccgaacatcgctaccacgctggtgaagctgttcgatctcaagccgattggcacggtcgaagctgatgttgaagcgatgatggccgggaactga

SEQ ID NO: 1796 - protein, 539 aa, Chlorobium tepidum
MHCDQCQESIKGGCNVRGVCGKDELTAKLQDTLIYAAEGIALCAEGFEGKIDRKYGQFISECLFVTVTNTNFDDVAIVEQIRKALAMRDEVRALAGTTPAHDAANWSGSTKEEFLAKAAACSIDSLSADPDLRSLKSLILYGIKGLAAYTDHAAVLGYHDDDIYAFYVKGLSALTKELPADELLGLVMECGATAVKAMALLDKANTETYGNPEITTVKTGVGTRPGILISGHDLRDMEDLLKQTEGTGVDVYTHCEMLPAHYYPAFKKYDHFVGNYGNSWWSQDREFESFNGPILMTTNCIVPVRESYRGRMFTTGMAGYPGLKHIPARPDGGSKDFSEIIELAKTCKPPIEIENGEIVGGFAHTQVLALADKVVDAVKSGAIRRFVVMAGCDGRHNSRQYYTDVAETLPKDTVILTAGCAKYRYNKLELGDIGGIPRVLDAGQCNDSYSLAVIAMKLQEVFGLENINDLPISYDIAWYEQKAVTVLLALLFLGVKGIRLGPTLPEFLTPNIATTLVKLFDLKPIGTVEADVEAMMAGN

SEQ ID NO: 1797 - DNA, 1650 bp, Clostridium perfringens
  CDS (1)..(1650): transl_table=11
atgagtatgttttgttttcaatgtcaagaaacagcaggatgcaaaggctgtactgtaagaggagtttgtggaaaaactgaagatgtagcaaaaatacaagaccttttaatttttgttactaaaggattagctacagtagctaatgaaggaagaaaagtagggatagtagataaaaaagtaaacagaatgataatagataacttatttattactattactaatgcaaactttgattttaaagcaatagaaaaaagagttaaagatactttagtagcaagagaagaattaaaagaaagagtacaagctaagggtggaaatccaattggatcagacttcaaaggatgtgcaacttggactgctacaactagtgaagaaatgatggaaaaagcttcacaagtaggagttttagctacagaaaatgaagatataagaagcttaagagaacttattatgtatggattaaaaggattagcagcatacatggagcatgctatgaatttaggacatgataaagaagaagttcatgcatttatggcagaaactttagttaaaatattagatgattcattaagcgcagatgaattaactgctttagcattagaaacaggaaaattcggtgttgatggaatggcattattagatgaagctaacacttcaacttatggtcatccagaaataacaaaagttaatataggagttagaaataacccaggaatattaatatcaggacatgatttaaaagacttagaaatgttattagaacaaacagaaggaactggagtagatgtttatactcatggtgaaatgttaccaggacactattatccaaaattcaagaaatatgctcactttgcaggaaactatggtaatgcatggtggttacaaaataaagagttcgcatcatttaatggaccaatattaatgacaacaaactgtataacaccagttcaagattcatatagaggaagaatatttacaacaggcgctgtaggatatgaaggatgtattcatataacagcagatgaaaatggatacaaagatttctcacaaataatagagttagctaagacttgcaaagctccaacagagattgaaacaggagaaatcgtaggtggatttgctcataatcaagtacttgctttagctgaccaagtagttgatgctgttaaatcaggtgcaataagaagattcttcgtaatggctgggtgtgatggaagagctaaatcaagagattactatagagaatttgctgaaaaattaccaaaggacactgttatattaacagctggatgtgctaaatataaatataataagttaccacttggagatatcaatggaattccaagagttttagatgcaggacaatgtaatgattcatactcattagttgtaatagctttaaaacttgctgaagtatttggaacagatagtgtaaatgaattaccaataagctacaacatagcatggtatgaacaaaaagctgtaatagtattattatcattattacacttaggtgttaaaaacattcatttaggaccaactttaccagcattcttatcaccaaacgtagctaaagttttagttgaaaactttggaattggtggaattacaaatgtagaagatgatatgaaaatgttcttaggagaataa

SEQ ID NO: 1798 - protein, 549 aa, Clostridium perfringens
MSMFCFQCQETAGCKGCTVRGVCGKTEDVAKIQDLLIFVTKGLATVANEGRKVGIVDKKVNRMIIDNLFITITNANFDFKAIEKRVKDTLVAREELKERVQAKGGNPIGSDFKGCATWTATTSEEMMEKASQVGVLATENEDIRSLRELIMYGLKGLAAYMEHAMNLGHDKEEVHAFMAETLVKILDDSLSADELTALALETGKFGVDGMALLDEANTSTYGHPEITKVNIGVRNNPGILISGHDLKDLEMLLEQTEGTGVDVYTHGEMLPGHYYPKFKKYAHFAGNYGNAWWLQNKEFASFNGPILMTTNCITPVQDSYRGRIFTTGAVGYEGCIHITADENGYKDFSQIIELAKTCKAPTEIETGEIVGGFAHNQVLALADQVVDAVKSGAIRRFFVMAGCDGRAKSRDYYREFAEKLPKDTVILTAGCAKYKYNKLPLGDINGIPRVLDAGQCNDSYSLVVIALKLAEVFGTDSVNELPISYNIAWYEQKAVIVLLSLLHLGVKNIHLGPTLPAFLSPNVAKVLVENFGIGGITNVEDDMKMFLGE

SEQ ID NO: 1799 - DNA, 1713 bp, Clostridium tetani
  CDS (1)..(1713): transl_table=11
atgagtatgttttgttatcaatgccaagaagcagcaggatgtaaaggctgtacagtaagaggagtatgtggaaagacagaagatgtagcaaaatcacaagatttattaatatatatattaaaaggaatttcagtatatggagtaaaaggaagagaagttggagttatcaacaaagaagtggataactttatggtagagggtctatttgctactataacaaacgctaactttgacagagaagtatttatagaaagaattaaaagaggattacaattaagacaagaattaaaagaacaagttataaaagcaggaggaaatgtagaaaattctcatgcaaataaaaactggttagataaaatgttatcttttgttggattgaaaaaagaagaagaaactaaacttccagatgcagccacatggttcgctgataatgtagaagaatttaatgctaaggctgaaaaagtaggagtattagcaacaaaagatgaagacataagatctttaagagaacttataacttatggaataaaaggactagcagcttatgtagagcacgctcataatttaaatttcgataatgaagaaatacatggatttatgcataaagcattagctgcaactttagatgatacattaacagtagatgatttagtagctttaactttagaaacaggtaaatatggtgtagaaggaatggcattacttgataaagctaatacacaaacttatggaaatccagaaataactaaagttaatataggagttagaaataatccaggtatattaataagtggacatgatctaagagatttagaacaactattagaacaaacaaaaggaacaggagtagatgtttatactcatagtgaaatgttaccagcacattactatccagcatttaaaaagtattcacactttgcaggaaactatggaaatgcttggtggaaacaaacagaagaattcgagaaatttaatggaccaatccttatgacaacaaactgtttagtaccgccaaaggattcatataaagatagagtttatactacaggggtagttgggttcccaggactaaagcatatagatgctgatgaaaagggagaaaaagacttctcaagcataattgaacatgccaaaaaatgtgcagcaccaacagaaattgaaaaaggagaaatagtaggtggatttgcacataaccaagtattccaattagcagacaaagtagtagaagcagtaaaaactggagcaataaagagattctttgttatggctggttgtgacggaagagctaaatcaagaaactactatacagaatttgctcaaaagcttccaaaggatacagtaatattaacagcaggttgtgctaaatacaaatataataaattgaacttaggagatattggaggaattccaagagtgctagatgcaggacaatgtaacgattcttattcattagcactaatagcattaaaattaaaagaagtatttgaattagaagatataaatgaattaccaatatcctataatatagcttggtatgagcaaaaagctgtaatagtattacttgcattattacacttaggagtaaaaaatattcacctaggaccaacattaccagcattcctatccccaaatgtagctaatgttttagtagaaaactttggaataggtggaataacaaacgtagaagatgacatgaaaatgttcttaggataa

SEQ ID NO: 1800 - protein, 570 aa, Clostridium tetani
MSMFCYQCQEAAGCKGCTVRGVCGKTEDVAKSQDLLIYILKGISVYGVKGREVGVINKEVDNFMVEGLFATITNANFDREVFIERIKRGLQLRQELKEQVIKAGGNVENSHANKNWLDKMLSFVGLKKEEETKLPDAATWFADNVEEFNAKAEKVGVLATKDEDIRSLRELITYGIKGLAAYVEHAHNLNFDNEEIHGFMHKALAATLDDTLTVDDLVALTLETGKYGVEGMALLDKANTQTYGNPEITKVNIGVRNNPGILISGHDLRDLEQLLEQTKGTGVDVYTHSEMLPAHYYPAFKKYSHFAGNYGNAWWKQTEEFEKFNGPILMTTNCLVPPKDSYKDRVYTTGVVGFPGLKHIDADEKGEKDFSSIIEHAKKCAAPTEIEKGEIVGGFAHNQVFQLADKVVEAVKTGAIKRFFVMAGCDGRAKSRNYYTEFAQKLPKDTVILTAGCAKYKYNKLNLGDIGGIPRVLDAGQCNDSYSLALIALKLKEVFELEDINELPISYNIAWYEQKAVIVLLALLHLGVKNIHLGPTLPAFLSPNVANVLVENFGIGGITNVEDDMKMFLG

SEQ ID NO: 1801 - DNA, 2834 bp, Desulfovibrio desulfuricans
  CDS (868)..(2505): transl_table=11
gcatgcacagatcatacgcaacatgctttcggtattcgcccgcaaggctttttttctgacgcgccgcgtatcactgctttcatcgggcagcctgcgtcgcaagatcgcctctttactgcttgagcaccgcaaccctgacggctcgctgaatctgctcatgaaccgtgaacagatggccgactttctgggcgtcacgcggccctcgctttcacgcgagctggcagccatgcgtgatgaaggcctgctgcacatcaacggaaaaaacatctccctgcctcatcccgaccgcctgaaagaattttacgattattctgttccgtaacaattgttacggacgtccacactcccccttggtatacaggaatcatcaaaagcaaggagggaaccatgcaacgcctgctcaagaatctggattacgccaccgcgctgcccctggccgcgcaggtggattgccagccgggccaggtagccagcaagacgcttgttcagaatgatgccgtgggtataacccttttcgcctttgacaagggcgaaaaaatcagcgcccacacctccacgggcgacgcctttgtgctggcccttgaaggacaggggcaagtgaccatcaacggacagaccagccccctcaaggccggagagtccatcatcatgcccgcagggcagccccattccgtcagcgctgtggagcgcttcaagatgctgctggttgtcatttttccgccggagtaacgccagcccgcccaccggcggcacaaaagcggcccggacagttttcataccgtaaacattttttcatccccgatgcccgcccgctgcgggtttcacccaagcctccgccgcaacggagccatataaggacaagacaccatgagtaatgccatgttctgctaccagtgccaggaaaccgtgggtaacaaaggctgcacccaggtaggcgtgtgcggcaaaaagcctgaaacagccgcccttcaggacgcgctgatctatgtgaccaagggcctcggccagatcgccacgcgcctgcgcgccgaaggcaaggccgttgaccacaggatagaccgcctggttaccggcaacctgtttgccaccatcaccaatgccaactttgacgacgacatccttgccgagcgtgtgcgcatgacctgtgccgccaaaaaggaactggccgcgtcccttaccgacaagagcggcctcagcgatgcagccttgtgggaagcatccgaaaagtccgccatgctggccaaggccggaaccgtaggcgttatggccaccaccgatgatgatgtgcgctccctgcgctggctcatcacctttgggctcaagggcatggcggcctacgccaaacatgcggatgtgcttggcaagcatgaaaacagccttgacgccttcatgcaggaagcccttgccaaaaccctggatgacagcctgagcgtggccgaccttgtggccctgacccttgaaacgggcaagttcggcgtatcggccatggccctgctggatgctgccaataccggtacctacggccacccagaaattaccaaggtcaacatcggcgtgggcagcaatcccggcatcctcatttccgggcatgacctgcgcgaccttgaaatgctgctcaagcagaccgaaggcacaggcgttgacgtgtacacccactctgaaatgctgcccgcccattactaccctgccttcaagaagtacgcgcacttcaagggcaactacggcaatgcatggtggaaacagaaagaagaatttgaaagctttaacggccccgtgctgctgaccaccaactgccttgtgccgcccaaggacagctacaaggaccgcgtgtacaccaccggcatcgtgggttttacgggctgcaagcatatccccggtgaaatcggcgaacacaaggacttcagcgccatcatcgcccatgccaagacctgtcccgcgcctacggaaatcgaatccggcgaaatcatcggcggcttcgcgcacaatcaggtactggccctggccgacaaggtgattgacgcggtcaaatccggcgccatcaaaaagttcgtggtcatggccggctgcgacggccgcgccaagtcccgcagctactacaccgactttgccgaaggcctgcccaaagacacggtcatccttaccgccggttgcgccaaatatcgctacaacaagctcaacctgggtgacatcggcggcatcccgcgcgtactggacgccgggcagtgcaacgactcctactccctggccgtcatcgccctcaagctcaaggaagtattcggcctcgaggacgtcaacgacctgcccatcgtctacaatatcgcctggtacgagcagaaggccgttatcgtgctgctggccctgctgagcctcggcgtgaagaatatccacctcggaccgacgctgcccgccttcctttcgcccaacgtggccaaggtgctggtggaacagttcaacatcggcggcatcaccagtccgcaggacgacctcaaggcgttcttcggctaacccttcccacaacacacccaaacaagcagaaggcgcgcaccggagtgcgcgccttttatttctttggtccagattaacgctggaatgtgaagtatttcaacgtggtcattctgcccaaacttgcaatatccggcagaatccacgccgtattgcggcgagctgcactctcgtgcagcgttagcccatgtaaactttttcataaggtaaacagcgctaccgcagttcgccttgcaaataaccgacgattacgcccagacaaggcacacctgcgccaatccgccgcaaggccttgccctcaagcccgtgcgcgcccttcaggcatagcatgc

SEQ ID NO: 1802 - protein, 545 aa, Desulfovibrio desulfuricans
MSNAMFCYQCQETVGNKGCTQVGVCGKKPETAALQDALIYVTKGLGQIATRLRAEGKAVDHRIDRLVTGNLFATITNANFDDDILAERVRMTCAAKKELAASLTDKSGLSDAALWEASEKSAMLAKAGTVGVMATTDDDVRSLRWLITFGLKGMAAYAKHADVLGKHENSLDAFMQEALAKTLDDSLSVADLVALTLETGKFGVSAMALLDAANTGTYGHPEITKVNIGVGSNPGILISGHDLRDLEMLLKQTEGTGVDVYTHSEMLPAHYYPAFKKYAHFKGNYGNAWWKQKEEFESFNGPVLLTTNCLVPPKDSYKDRVYTTGIVGFTGCKHIPGEIGEHKDFSAIIAHAKTCPAPTEIESGEIIGGFAHNQVLALADKVIDAVKSGAIKKFVVMAGCDGRAKSRSYYTDFAEGLPKDTVILTAGCAKYRYNKLNLGDIGGIPRVLDAGQCNDSYSLAVIALKLKEVFGLEDVNDLPIVYNIAWYEQKAVIVLLALLSLGVKNIHLGPTLPAFLSPNVAKVLVEQFNIGGITSPQDDLKAFFG

SEQ ID NO: 1803 - DNA, 1890 bp, Desulfovibrio vulgaris
  CDS (183)..(1844): transl_table=11
ggatcctgtgctgtgtaaggggttgcccacagacgacacgtacggtgccctggatcgtctggcggatgcattgccgccaagcacaaggaaagcggctttcagaggtagttttttttctagtatcgatttgaggtgcgtgcattgtcacgcgatcggcaacagtaattataaaggaggtcactatgttttgcttccagtgtcaggaaacagcgaagaatacgggatgcacggtcaaaggtatgtgcggcaagccggaagaaaccgccaatttgcaggatctgctcatttttgtgctgcgtggcatcgccatttatggcgaaaaattaaaggagttgggacagccggaccgctctaatgacgacttcgtgctccagggattatttgcgaccatcaccaatgctaactgggatgatgcccgatttgaggctatgatatcggaaggcttggctcggcgtgacaagttgagaaatgcttttctggctgtttacaaggcaaaaaatggcaaagatttcagcgagccgttgcccgaagccgcgacttggactggggactctaccgcttttgctgaaaaggccaagagcgtaggcattctggcaactgagaacgaagatgtgcgttctttgcgcgaactgctcataatcggtctgaaaggtgtcgcggcctatgccgagcacgctgctgtactgggctttcgcaagaccgaaatcgacgaattcatgcttgaggccctggcttcaacgaccaaggatttgtccgtggatgaaatggtcgcgctggtcatgaaggccggcggcatggccgtaaccaccatggccctgctggacgaggccaacaccactacctacggcaacccggaaatcacccaggtcaacatcggcgtgggcaagaaccccggcatcctcatcagcggccatgacctgaaggatatggccgagttgctgaagcagaccgagggcacaggcgtggacgtttacacccacggcgaaatgcttcccgccaactattatccggcgttcaagaagtacccgcatttcgtggggaactacggcggttcctggtggcagcagaatcccgaattcgagtccttcaacggccccatcctgctgaccacaaactgtctggtgccgctcaaaaaagagaacacctatctggaccgtctctacaccactggcgtggttgggtatgaaggggccaagcacatcgctgaccggcctgcgggaggagccaaggatttctcggcgctgatcgcacaggccaagaaatgtcctccgcccgttgagatcgagactggtagcatcgtcggcggtttcgcccatcatcaggtactagccttggccgacaaggtggttgaggctgtcaagtccggcgcgatcaagcgctttgtggtcatggccgggtgtgacggtcggcagaagtctcgttcctattacactgaagtggccgaaaatttgcccaaggacaccgtgatcttgacggccggttgcgccaagtaccgctataacaaactgaatctcggtgacatcggtggcattccacgtgtgctggacgcagggcagtgcaacgattcctattccctggccgtcattgctctgaaactcaaagaagtcttcggcctggatgacatcaacgatctgcccgtatcttacgatatcgcctggtacgagcagaaggccgtggccgtgcttctggccctcctattcttaggtgtgaagggaatccgcctcggacccacgcttccggcattcctgtccccgaacgtggccaaggtactggttgaaaatttcaacatcaaaccaatcggaacagtgcaggatgacatcgcggccatgatggcgggtaaatagatgaagggggggcttcggctcccctttttttcatcaatagctgatc

SEQ ID NO: 1804 - protein, 553 aa, Desulfovibrio vulgaris
MFCFQCQETAKNTGCTVKGMCGKPEETANLQDLLIFVLRGIAIYGEKLKELGQPDRSNDDFVLQGLFATITNANWDDARFEAMISEGLARRDKLRNAFLAVYKAKNGKDFSEPLPEAATWTGDSTAFAEKAKSVGILATENEDVRSLRELLIIGLKGVAAYAEHAAVLGFRKTEIDEFMLEALASTTKDLSVDEMVALVMKAGGMAVTTMALLDEANTTTYGNPEITQVNIGVGKNPGILISGHDLKDMAELLKQTEGTGVDVYTHGEMLPANYYPAFKKYPHFVGNYGGSWWQQNPEFESFNGPILLTTNCLVPLKKENTYLDRLYTTGVVGYEGAKHIADRPAGGAKDFSALIAQAKKCPPPVEIETGSIVGGFAHHQVLALADKVVEAVKSGAIKRFVVMAGCDGRQKSRSYYTEVAENLPKDTVILTAGCAKYRYNKLNLGDIGGIPRVLDAGQCNDSYSLAVIALKLKEVFGLDDINDLPVSYDIAWYEQKAVAVLLALLFLGVKGIRLGPTLPAFLSPNVAKVLVENFNIKPIGTVQDDIAAMMAGK

SEQ ID NO: 1805 - DNA, 1653 bp, Escherichia coli
  CDS (1)..(1653): transl_table=11
atgttttgtgtgcaatgtgaacaaactatccgtactccggcaggaaacggctgctcatacgcgcaggggatgtgtggtaaaacggcggaaacttctgaccttcaggatttactcatcgcggcgctgcaagggctttctgcctgggcggtaaaagcgcgtgaatacggcatcatcaaccacgatgttgacagcttcgcgccacgtgcctttttctcaaccctgaccaacgttaacttcgattctccgcgtattgtcggctacgctcgtgaagcgattgccttgcgcgaggcgctgaaagcacaatgcctggctgtagatgccaacgcgcgcgtcgataacccgatggctgacctgcaactggtgagcgatgatctcggcgagctgcaacgtcaggcagcagaatttacccctaacaaagataaagcggcgattggcgaaaacattctcggcctgcgtctgctgtgcctgtatggcctgaaaggtgcggcggcctatatggaacacgcgcatgttctcggtcaatacgacaacgatatttatgcccagtaccataaaatcatggcgtggctggggacctggcctgccgatatgaacgcgcttcttgagtgttcaatggaaatcggccagatgaacttcaaagtgatgagcattctggatgcaggcgaaaccggtaaatacggtcacccgacgccaacccaggtcaacgtcaaagcgacggcgggtaaatgcatcctgatttccggtcacgatctcaaagatctctacaacctgctggaacagaccgaaggcacgggcgttaatgtttacacccacggcgaaatgctgcctgcgcatggctacccggagctgcgtaaattcaagcatctggtcggtaactacggcagcggctggcagaatcagcaagtggagttcgctcgtttccctggccccatcgtgatgacctcgaactgcatcatcgacccaaccgtaggcgcttatgacgatcgtatctggacccgcagcattgttggctggcctggcgtgcgtcatctggacggtgatgatttctctgcggttatcacccaggcgcaacagatggcaggcttcccgtacagcgaaattccgcaccttatcaccgtgggttttggtcgccagacgctgcttggcgctgctgatacgctgattgatctggtgagccgtgaaaaactgcgtcatatcttcctgcttggtggctgtgacggcgcacgcggcgagcgccactacttcaccgatttcgccaccagcgtgccggatgactgcctgatcctgaccctcgcctgtggtaaatatcgctttaacaaacttgagtttggcgatatcgaaggtctgccgcgtctggtagatgcaggtcaatgtaacgatgcttactcagcgattattctggctgtcactctggcagagaaactgggctgtggtgtgaacgatctgccgctgtcgctggtgctctcctggtttgaacagaaagcgatcgtcattctgctgacgctgctttctctgggcgtgaaaaatatcgtcaccggcccgactgcacctggtttcctgacaccagacctgctggcggtgctgaacgagaaattcggcctgcgttctatcaccactgttgaagaagacatgaagcaactgttgagcgcgtaa

SEQ ID NO: 1806 - protein, 550 aa, Escherichia coli
MFCVQCEQTIRTPAGNGCSYAQGMCGKTAETSDLQDLLIAALQGLSAWAVKAREYGIINHDVDSFAPRAFFSTLTNVNFDSPRIVGYAREAIALREALKAQCLAVDANARVDNPMADLQLVSDDLGELQRQAAEFTPNKDKAAIGENILGLRLLCLYGLKGAAAYMEHAHVLGQYDNDIYAQYHKIMAWLGTWPADMNALLECSMEIGQMNFKVMSILDAGETGKYGHPTPTQVNVKATAGKCILISGHDLKDLYNLLEQTEGTGVNVYTHGEMLPAHGYPELRKFKHLVGNYGSGWQNQQVEFARFPGPIVMTSNCIIDPTVGAYDDRIWTRSIVGWPGVRHLDGDDFSAVITQAQQMAGFPYSEIPHLITVGFGRQTLLGAADTLIDLVSREKLRHIFLLGGCDGARGERHYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFLTPDLLAVLNEKFGLRSITTVEEDMKQLLSA

SEQ ID NO: 1807 - DNA, 1620 bp, Methanococcus jannaschii
  CDS (1)..(1620): transl_table=11
atgttctgcttccaatgtcaagaggcagcaaaaaatgaaggatgtacaataaaaggagtctgtggaaaagatgatgttgtggcaaacctccaagatttattgatttatactataaaaggtttatgctatgtctgtgataaaggcaattacttggatgatgaagttatggattacattccaaaagcattatttgtaacaataactaacgtcaattttgatgataaagatgtaataaattggataaagaaaggagtcgctttaagagaaaaaattatagaaaaaaataatttaaataaagaagaacttccatactgtgctacttgggcttacgaaactgatgaagatctaataaatttagccaatacaaaagaagttagcgtcttagcagaggataatgaagacataagatcattaaaagagcttataacttatggaattaaaggaataggagcttatctaagccatgccatgcatctcggctacaacaatgaggacattcataagtttataattaaagcattcactaaaatcgttgatagcaaagatgctgatgagttatttaatttagcaatggagacaggaaagtatgcagtagaaacgttagcattattagataaagcgaacactgaaacctatgggcatccagaaataacagaggttaatttgggagttagagacagaccaggaatattgattagtggtcacgacttaaaagatttagagcaattattagagcaaagtaaggatgcaggagttgatatctacacccactgtgagatgttgccagcccactactacccattctttaagaaatatgagcacttcgttggaaattatggaggttcatggccgttccaaagagaggaatttgagaaattcaacggtccaatagtgatgacgacaaactgtttagttccaccaaaggactcatataaagatagggtttatgtaaccaacgaagttggctatcctggcttaaagagaatcccagtaaaagaggatggaactaaggacttttcagaggttatagagcacgctaaaaaatgcaaaccaccaacaccactcgaaaatggtaagattgttggaggattcgctcataaccaagttttagcactggcagataaagtaattgaagcagttaaaagtggaaaaataaggaaattcgttgtaatggccggatgtgatggaaggcataaaacaagagagtattatactgaatttgctaaaaaactgcctaaagatactgttatattaacatgtggatgtgcaaaatatagatttattaaattagatttgggagacattgatggaattccaagagttttagatgctggacagtgtaatgatagctattcgttagttaaaattgcactggctttaaaagatgcatttggcttaaacgatgtaaatgaacttccaatcgcttataacatctcatggtatgagcaaaaggcagttactgtattattagctttgctttacttgggagttaagaatatagtattaggccctacactaccagcgttcttatcaccaaatgtgacaaaagttttagttgagaagtttggaatctcaacgatctcaacagttgatgaagatattaaaagattagttgggtaa

SEQ ID NO: 1808 - protein, 539 aa, Methanococcus jannaschii
MFCFQCQEAAKNEGCTIKGVCGKDDVVANLQDLLIYTIKGLCYVCDKGNYLDDEVMDYIPKALFVTITNVNFDDKDVINWIKKGVALREKIIEKNNLNKEELPYCATWAYETDEDLINLANTKEVSVLAEDNEDIRSLKELITYGIKGIGAYLSHAMHLGYNNEDIHKFIIKAFTKIVDSKDADELFNLAMETGKYAVETLALLDKANTETYGHPEITEVNLGVRDRPGILISGHDLKDLEQLLEQSKDAGVDIYTHCEMLPAHYYPFFKKYEHFVGNYGGSWPFQREEFEKFNGPIVMTTNCLVPPKDSYKDRVYVTNEVGYPGLKRIPVKEDGTKDFSEVIEHAKKCKPPTPLENGKIVGGFAHNQVLALADKVIEAVKSGKIRKFVVMAGCDGRHKTREYYTEFAKKLPKDTVILTCGCAKYRFIKLDLGDIDGIPRVLDAGQCNDSYSLVKIALALKDAFGLNDVNELPIAYNISWYEQKAVTVLLALLYLGVKNIVLGPTLPAFLSPNVTKVLVEKFGISTISTVDEDIKRLVG

SEQ ID NO: 1809 - DNA, 1623 bp, Methanosarcina mazei
  CDS (1)..(1623): transl_table=11
atgttctgtaatcaatgtcaggaagcgcttaacgtaatagggtgtactaaaaacggcgtatgcggcaaaaaaggggaagttgcagacctgcaggacaggcttttatacgtccttaaaagcgtctcttattataacctgaaggcaagagaactgggccttaatgaggaaacagccgacaaaattgtacttgacgctttctttgcaactcttacgaacactaactttgacaaacaggcaattgaatcctatataaagaaagggtttgagatccgtgactccattaaggcaaaactgccagccggaactctgcctgccgaagaagacctccctgatgtggcaaaggtcacccccgaaaacataacagggatggatgtcgctgtccactccacgcaaaacgaagatgtccggtctcttagagaattgctgacatatggaatgaagggaatggctgcatatgcacaccacgcctatatcctcgggtataaagacgaagagatctttaaattcattgaaaaagggctggttgccacaacagacgacaccataggtgtggatgaccttatcggccttgttcttgaatgcgggcaaaaaggcgtatcagtacttgcactgcttgataaggcaaacaccgagacctatggtagccccgagccgactgcagtcaatatcggcgtaaggggaaatccgggaatccttatcagcgggcatgaccttctggaccttgaacagctccttgagcagacaaagggaacaggaatcgatgtctacactcacggagagatgcttcccgcaaactcatatcctgcctttaagaagtacgacaattttgcgggcaactatggtaacgcctggtggagacagaatgaggagtttgaaaagtttaacggcccagtcctcatgaccacaaattgcataatcccgccaagagagtcatacagaaacaggatctacacgaccggggttgtgggctttgaagggcttccgcatatccacgaaaaagaagacggaacaaaagatttcacctcccttatagaacaggcaaaaatgagcaagccccctgaacaactggaaagcgggacaatcatgggaggctttgcacatgaagcagccttatcggttgcggataagatcatagatgccgtaaaaacaggaaaaatcagcaggttcatggtcatggcaggctgtgacggaaggcacaaggaaagggcatattacaccgagtttgcaaaagcccttccagaaaacacagtaatcctgaccgcaggctgtgcaaaataccgctacaacaagctcgacctgggcgacatcggaggaattccgagagttctcgacgccgggcagtgcaacgactgttactcgcttgtggtaatagcccagaagcttgcagaagccttcgggcttgaggacataaatgaccttcctatctcttacaacattgcctggtatgagcagaaagccgtacttgtcctgctcgcccttctgagcctcggagtgaaaaacatagtcctcggcccgacccttccggcttttgtctctccgaatgttctcaaggtactggttgataacttcaatatcagacccaacacaactgtagaagaagatatgaaagtcctgctgggttga

SEQ ID NO: 1810 - protein, 540 aa, Methanosarcina mazei
MFCNQCQEALNVIGCTKNGVCGKKGEVADLQDRLLYVLKSVSYYNLKARELGLNEETADKIVLDAFFATLTNTNFDKQAIESYIKKGFEIRDSIKAKLPAGTLPAEEDLPDVAKVTPENITGMDVAVHSTQNEDVRSLRELLTYGMKGMAAYAHHAYILGYKDEEIFKFIEKGLVATTDDTIGVDDLIGLVLECGQKGVSVLALLDKANTETYGSPEPTAVNIGVRGNPGILISGHDLLDLEQLLEQTKGTGIDVYTHGEMLPANSYPAFKKYDNFAGNYGNAWWRQNEEFEKFNGPVLMTTNCIIPPRESYRNRIYTTGVVGFEGLPHIHEKEDGTKDFTSLIEQAKMSKPPEQLESGTIMGGFAHEAALSVADKIIDAVKTGKISRFMVMAGCDGRHKERAYYTEFAKALPENTVILTAGCAKYRYNKLDLGDIGGIPRVLDAGQCNDCYSLVVIAQKLAEAFGLEDINDLPISYNIAWYEQKAVLVLLALLSLGVKNIVLGPTLPAFVSPNVLKVLVDNFNIRPNTTVEEDMKVLLG

SEQ ID NO: 1811 - DNA, 1995 bp, Photobacterium phosphoreum
  CDS (210)..(1871): transl_table=11
ccgtatgggtaaaaagctcggtattaagtaagatttatcgcgtaaatgatgtcataaacacaacccgccagatgtgtatttgacatcaaaacaatccataccaacgataaaatcgttatataacataaacttaaaaattggcatagttactgctaggtgatgaattaattattatttataacaataatcaccacactggagattttttgatgttctgtattcaatgtgaacaaacccttgaagcccctaaaaagaaaggctgtgcttatgccacaggtatgtgtggtaaaaccgctgaaatttcagacctacaagatgtgttagtttacatactacaaggtgtttcttattgggccgatttagcgcataagtttgatattattgatgatgaaattaaccattgggcaccacgcgcattttttgcaaccttaaccaatgtcaactttgatcgtgaacgtattttagctttagctaacctcgcagaaaattataaaacacgtctcaaacaagcagtaatagcagcaacaacactagcgcagcaaccattaccaaccctacctaccgtggctgaatttacattaccgaatactatcgatgccatcctaacgctcgcgccacaagtagcggttaaccgcggttatgaaacgattaatgaagatgttattggtttacgtttattatgtctatacggcctgaaaggcgcagctgcttatatggagcatgcacgtgtattagggcaaacaaacaatgctatttatgctcaatatcatcacatcatgagctggttaggtacggatccaaccgatcttaatgcattacttgaatgttcaatggaaattggtctgatgaattacaaagtgatggaaatgctcgatttaggcgaaaccaacactttcggtcatccactaccaagccaagtgaacgttaaacctattcaaggaaagtgtattttagtttcaggccatgacttgcacgaccttgaaaaaatcttgcaacaaactgaaggtaaacatattaatgtttatactaatggtgaaatgttacctgcccatagttatcctgaattaaagaaatatccacatctcgtcggtaactacggcagtgcatggcaaaatcaacaacttgagtttgccaacttccctggcgcgatagtaatgacctcaaactgcctaattaatccgaatgtaggtaaatatgcagatcgtatctttactcgcagtatcgtagcatggccaggtgtagcacatattgaaggcgatgattttagtcaagtgattgattgtgccttagccttagatggctttcagcacacagaaatcgaacatatgatcactatcggttttggtcgtaatgctctaatgaatgctgcaccagccgttatcgatcaagttaagcaaggtaatattaaccacttctttcttgttggtggctgtgatggtgctaaagaagaacgtagttatttcactgattttgcagcacaagtacctcaagactcactaatcttaactttagcttgtggtaaatatcgatttaataaaaataactttggtgacattaatggtattccacgtctactcgatgtgggccaatgtaatgatgcttattcagcgattcaacttgcactagcattagctaatgaatttgattgtagcattaacgaattaccactaaccttagtgctgtcttggtttgaacaaaaagcgattgtaattctactaaccttgtttgcacttggtgttaaaggtatttacaccggccctactgcacctgcatttttaacagataacctactcgctattattgcagaaaaatttgatatgcgttcgatatcaaccccagaggcagatcttaataccattttaagcgcataaacttaatctaatttatatgttttaaataaaataagcccgataaaaagcgggctaattttattcataaaaagggtcaatattcatttatcaaaattaaagcaatggcggccatgagaagctttcg

SEQ ID NO: 1812 - protein, 553 aa, Photobacterium phosphoreum
MFCIQCEQTLEAPKKKGCAYATGMCGKTAEISDLQDVLVYILQGVSYWADLAHKFDIIDDEINHWAPRAFFATLTNVNFDRERILALANLAENYKTRLKQAVIAATTLAQQPLPTLPTVAEFTLPNTIDAILTLAPQVAVNRGYETINEDVIGLRLLCLYGLKGAAAYMEHARVLGQTNNAIYAQYHHIMSWLGTDPTDLNALLECSMEIGLMNYKVMEMLDLGETNTFGHPLPSQVNVKPIQGKCILVSGHDLHDLEKILQQTEGKHINVYTNGEMLPAHSYPELKKYPHLVGNYGSAWQNQQLEFANFPGAIVMTSNCLINPNVGKYADRIFTRSIVAWPGVAHIEGDDFSQVIDCALALDGFQHTEIEHMITIGFGRNALMNAAPAVIDQVKQGNINHFFLVGGCDGAKEERSYFTDFAAQVPQDSLILTLACGKYRFNKNNFGDINGIPRLLDVGQCNDAYSAIQLALALANEFDCSINELPLTLVLSWFEQKAIVILLTLFALGVKGIYTGPTAPAFLTDNLLAIIAEKFDMRSISTPEADLNTILSA

SEQ ID NO: 1813 - DNA, 1653 bp, Porphyromonas gingivalis
  CDS (1)..(1653): transl_table=11
atggaaaagaaaatgttttgctatcaatgccaggaaacagccggcaataagggatgtatcctcaaaggggtatgcggtaaggactttagtacagctaatctgatggatttgctcgtctttaacctcaaaggtattgccatcataatgacttctatgaggcgtgccggagtgaaagccgattaccgaaaggctgacaaggcgatcatggaatctctatttgccacaattaccaatgccaacttcgactactcttccatagccaaacgtgtagagaaaacgttcgcactcaaagcggaattgtacagtttggcttttactcaaggcatagagcttcccgaaaatgaagcagtgacgatgcagggaaagccggaagaatatgatcggttggctctcagtgtaggtattctaagagagacagacgaagatgtacgttctctcaaagagctgacgatctatggactcaaaggattggcagcctatgcggagcatgcggatcgactcggctacgtggatgaagagatcaatgccttcaccgaacgtgcgctgcacgatgtgacgatgggattgctttcggcagaagagctgacggctcttgtactggaaaccggttctttcggagtgaaggtaatggctctgctcgacaaagctaataccgagacttatggcaatccggaaatcacggaagtaaatataggtgtcggttcgcgcccgggtatccttatcagcggtcatgatctgaaagatatggagatgctgctcgagcaaactgaaggaacaggaatagatgtgtacacacacggtgaaatgctaccggccaactattatcccaaattcaaaaaatacaaccacttcttcggcaattacggcaatgcatggtggaaacagcgtgaggagttcgaaaccttcaacggccctatccttttcaccacaaactgtatcgtcccccctaaggccaatgcttcctacaaggatcgggtatttaccaccaacgctacgggctatccgggattcaagtacatcgagagcgatcagcacgggcgcaaggacttcagcgaaatcattgccttggccaagacgtgccaacctcccacagagattgagagcggcactatcataggaggctttgcacaccatcaggtattgagcatcgccgacaaagtagtggaggctgtcagcagtggagcgatccgcaagtttgtagtgatgagcggttgtgacggccggcagagtgggcgcaattattacacggagtttgccgaagctcttccttccgatacggttatccttacatcgggatgcgccaagttccgatacaacaaattgcagcttggcgacattgggggcatccctcgcgttctcgatgccggacagtgtaatgacagttattcgctggcggtaattgccctgaagctgaaagaagtaatgggattggatgacatcaacaaactaccgatcgtctacaacattgcatggtacgaacagaaagctgtcatcgtcctgctcgctctactcagcctcggtgtcaagaacatccatgtaggccctaccctacctgcattcctatcaccgaatgtagcgaaagtgctgatcgaaaacttcggtatagcaggtatcggtacggtcgaagaagatattcggacgctgatcgcataa

SEQ ID NO: 1814 - protein, 550 aa, Porphyromonas gingivalis
MEKKMFCYQCQETAGNKGCILKGVCGKDFSTANLMDLLVFNLKGIAIIMTSMRRAGVKADYRKADKAIMESLFATITNANFDYSSIAKRVEKTFALKAELYSLAFTQGIELPENEAVTMQGKPEEYDRLALSVGILRETDEDVRSLKELTIYGLKGLAAYAEHADRLGYVDEEINAFTERALHDVTMGLLSAEELTALVLETGSFGVKVMALLDKANTETYGNPEITEVNIGVGSRPGILISGHDLKDMEMLLEQTEGTGIDVYTHGEMLPANYYPKFKKYNHFFGNYGNAWWKQREEFETFNGPILFTTNCIVPPKANASYKDRVFTTNATGYPGFKYIESDQHGRKDFSEIIALAKTCQPPTEIESGTIIGGFAHHQVLSIADKVVEAVSSGAIRKFVVMSGCDGRQSGRNYYTEFAEALPSDTVILTSGCAKFRYNKLQLGDIGGIPRVLDAGQCNDSYSLAVIALKLKEVMGLDDINKLPIVYNIAWYEQKAVIVLLALLSLGVKNIHVGPTLPAFLSPNVAKVLIENFGIAGIGTVEEDIRTLIA

SEQ ID NO: 1815 - DNA, 1653 bp, Salmonella typhimurium
  CDS (1)..(1653): transl_table=11
atgttttgtgtgcaatgtgaacaaaccatccgtacaccagccggaaacggctgctcctacgcgcagggaatgtgcggtaaaacagctgaaacgtccgatctgcaggatctgctgattgcggctttgcaaggtttgtctgcctgggcggtgaaggcccgtgaatatggcatcattaatcacgacgttgataactttgcgccgcgcgcgtttttctccacgctgaccaacgttaacttcgactctccgcgtatcgtcggctacgcccgtgaagcgattgccttgcgtgaagcgttgaaagcgcagtgcctgagcgtggatgccaatgcgcattgcgacaatccgatggccgatctgcaactggtcagcgacgatctgggcgacctgcaacgtcaggcggcggaatttaccccgaataaagacaaagccgccattggcgagaacatcctcggcctgcgtctgctgtgcctgtacggtctgaaaggcgcggcggcgtatatggagcacgcgcacgttctcggtcaatacgacaacgacatttacgcgcagtaccacaaaatcatggcctggctgggcacctggcctgctgacatgaacgcgctgctggagtgcgcaatggaaatcggccagatgaacttcaaagtgatgagcattctggacgccggtgaaaccaccaaatacggtcaccctacgccgactcaggtcaacgtcaaagcgactgaaggcaagtgcattctgatctccggtcacgatctgaaagatctctacaacctgctggagcagaccgaaggcaccggcgttaacgtctacactcacggtgaaatgctgcccgcacacggctatccggaactgcgtaaattcaagcatctggtcggtaactacggcagcggctggcagaatcagcaggtcgaattcgcccgcttccctggcccaatcgtgatgacttctaactgcattatcgacccgaccgtgggcagctatgacgaccgtatctggacccgtagcatcgtcggctggccgggcgttagccatcttgaaggcgatgacttcgggccggtcattgcccaggcgcagcaaatggcgggcttcccgtatagcgaaattccgcatatcatcaccgtcggttttggccgtcagaccctgctcggcgctgccgatacgctcatcgatctggtcagccgtgaaaaactgcgtcacatcttcctagtcggcggctgtgacggcgcgcgcggcgagcgtaactactttaccgatttcgccaccagcgtgccggatgactgcctgatcctgaccctggcgtgcggtaaataccgtttcaacaaactggagttcggcgacatcgaagggctgccgcgtctggtcgatgccggtcagtgtaacgatgcttactccgcaattatcctggcggtgacgctggcggaaaaactgggctgcggcgtcaacgatctgccgctatcgctggtgctctcctggtttgagcagaaagcgatcgtgattctgctgacgctgctgtcattaggcgtgaaaaatattgtcaccgggccgaccgcgccgggcttcttcacgccggatctgctggctatcctcaacgagaagttcggtctgcgttccgtgaccaccgttgaagaagacatgaagcaattgctgagcgcgtaa

SEQ ID NO: 1816 - protein, 550 aa, Salmonella typhimurium
MFCVQCEQTIRTPAGNGCSYAQGMCGKTAETSDLQDLLIAALQGLSAWAVKAREYGIINHDVDNFAPRAFFSTLTNVNFDSPRIVGYAREAIALREALKAQCLSVDANAHCDNPMADLQLVSDDLGDLQRQAAEFTPNKDKAAIGENILGLRLLCLYGLKGAAAYMEHAHVLGQYDNDIYAQYHKIMAWLGTWPADMNALLECAMEIGQMNFKVMSILDAGETTKYGHPTPTQVNVKATEGKCILISGHDLKDLYNLLEQTEGTGVNVYTHGEMLPAHGYPELRKFKHLVGNYGSGWQNQQVEFARFPGPIVMTSNCIIDPTVGSYDDRIWTRSIVGWPGVSHLEGDDFGPVIAQAQQMAGFPYSEIPHIITVGFGRQTLLGAADTLIDLVSREKLRHIFLVGGCDGARGERNYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFFTPDLLAILNEKFGLRSVTTVEEDMKQLLSA

SEQ ID NO: 1817 - DNA, 1665 bp, Shewanella oneidensis
  CDS (1)..(1665): transl_table=11
atgttctgtattcagtgtgagcaaactattcgtactccagccggcaacggttgtagctatgcccaaggtatgtgtggcaaattggccgcgacctccgatctgcaagacttattaatctacatgctgcagggggtttcagtgtatgcggtaaaagcgcgcgagctaggtgttgtggatacagaggtagatacctttgttcctaaagcctttttctcgaccttaaccaacgttaacttcgatgatgaacgcattatcgcctatgccaagcaggcagctcagtaccgtgaaagtctaaaaaatgcttatgaagcgacttgtgaacagagtgggaaaacggcagagcagatgccgccagtcgcgcagttagtgttaggtaccagcaagcttgaaatgctatctcaagcgcctatctccttgctcaataaagataaaaataacattcatgaagatattttaggacttcgattactctgtttatacggccttaaaggcgcagccgcttatatggagcatgcacgtgtactaggtaaaaccgatgtggacattgctgcggatttccatcgaatcatggcgtttctcggtgaaccgagtgtcgatgcggataaattattctccactgcgatggagattggccaattaaactatcgcattatggctttgctcgatgcgggtgaaaccgaagcctttggtcatccagagccaacagtggttaatactaaacccgttaaaggcaaagccattttagtttctggccatgatatgaaggacttagagcttatccttgagcaaacggcgggcaaaggtattaatgtttatacccatggcgaaatgctgcctgcgcttgcgtatcccgcctttaaaaaatacccccatttagtgggtaactacggcagtgcatggcagaaccagcaaaaagaatttgccaatttccctggcgctgtggtgatgacatctaactgtattattgacccgaatgtgggccaatacagcgaccggatctttactcgaagcattgtgggttggcctggtgttgtccatgtgactggtgatgatttttcggtggtgattgagaaagcgctgtcgaacgatggattccactacgatgaaattccacacaatatcactattggttttgctcgcaatgcgctcatggctgccgccccaacggtagttgaaaatgtgaaaaacggttctatcaaacacttcttcttagtcggtggttgtgacggtgataagtcagagcggagctatttcaccgatttagctaagtctgcaccgaaggattccatcatcctgaccttaggttgtggtaagtacaaattcaacaagttggagtttggcgatatcaatggtattccacgtttactcgatatcggtcagtgtaatgatgcctattctgctatccagttagcgatcgcgttatcacaaatctttgaatgcgatattaatgaattaccactgaacttagtgctttcatggtttgagcaaaaagccattgtcgtactgctgacgttgttgtcgctcggggtgaaaaacatccgtacgggcccaacgccaccggcgtttttaacggctaatctcgccaagattttggaagacaagtttggcttgcgtaacaccaccaccgttgaagccgatctgaaaaccatgctgaacgtggcttag

SEQ ID NO: 1818 - protein, 554 aa, Shewanella oneidensis
MFCIQCEQTIRTPAGNGCSYAQGMCGKLAATSDLQDLLIYMLQGVSVYAVKARELGVVDTEVDTFVPKAFFSTLTNVNFDDERIIAYAKQAAQYRESLKNAYEATCEQSGKTAEQMPPVAQLVLGTSKLEMLSQAPISLLNKDKNNIHEDILGLRLLCLYGLKGAAAYMEHARVLGKTDVDIAADFHRIMAFLGEPSVDADKLFSTAMEIGQLNYRIMALLDAGETEAFGHPEPTVVNTKPVKGKAILVSGHDMKDLELILEQTAGKGINVYTHGEMLPALAYPAFKKYPHLVGNYGSAWQNQQKEFANFPGAVVMTSNCIIDPNVGQYSDRIFTRSIVGWPGVVHVTGDDFSVVIEKALSNDGFHYDEIPHNITIGFARNALMAAAPTVVENVKNGSIKHFFLVGGCDGDKSERSYFTDLAKSAPKDSIILTLGCGKYKFNKLEFGDINGIPRLLDIGQCNDAYSAIQLAIALSQIFECDINELPLNLVLSWFEQKAIVVLLTLLSLGVKNIRTGPTPPAFLTANLAKILEDKFGLRNTTTVEADLKTMLNVA

SEQ ID NO: 1819 - DNA, 1650 bp, Thermoanaerobacter tengcongensis
  CDS (1)..(1650): transl_table=11
atgaagatgttttgttatcaatgtcaggaggcattgaagaatacaggatgtacgacaattggtgtgtgcggcaaaacagccgatgtagcaaaccttcaggatttgctaatttttaccctgaagggcatatcttttttaaacttaaaggcaagagaagtcggtgtaaataaagaaaaaacagatcgcttcctaattgaaggcttattttctacaattacaaatgtgaattttgacaggaacttcttcttaagaaaaataaaagaagcagtggcattgagggatgaaatcaaagaagaccttagaaataaaggtgtaagagtagacgaatataaaaatatagatgccatttcatggacttatggcacggatgccgatatagaagcaatttctcaggaagtaggagttttatctacagaagatgaagacataaggtctttaagggagttaataacttatggtgtaaagggtatggcagcctatgcatatcatgcatatcaactgggttataaagatgacaatatatttaagtttatggagaaagcattggctaaggttttagatgacagtttgacagtggatgactatgtggctttggcaatggagacagggaaatacggcgtagatacaatggcacttcttgacaaagccaatacttctacctacggtcatcctgagataacaaaagtcaatattggagtgagaaataatccaggaatattggtaagcggtcacgatttaaaggacttagaacagcttcttgagcaaactgctggcacaggtgtagatgtatatactcatggagagatgttaccagctcactattatcctgcttttaagaaatatcctcactttgtaggcaattatggcaatgcatggtggcagcaggacaaggaattcgaactatttaacggaccaattttaatgactacaaactgcctcattccgcctaaagactcttataaagacagagtctacactacaggcgtcgtaggctttgaaggggtaaaatacattcctgaaggaccagatggtaagaaagatttctcagagataattgagcatgccaaaagatgcaaacctcctgtagagattgaaagaggagaaataataggaggctttgctcacaaccaggttttacagttagcggataagattgtagaagcagtaaagacaggagcaataaagagattctttgtaatggcaggctgcgacggaagaatgaaaagtagaacctattatacagaatttgccaaagctcttccaaaagacacagtgattctaaccgcaggatgtgcaaaatacagatacaacaagctaaatcttggagacatagatggcattccaagagtattagatgccggacagtgcaacgactcttattcccttgctgtaatagcaatgaagcttaaagaaatattcggattaaacgacataaacgaacttcctatatcatataacattgcatggtatgaacaaaaagctgtaatagtacttctggcactactttaccttggagtaaaaaatattcacttaggcccaacacttcctgctttcctatcaccaaatgtgacaaaagtattagttgagaaatttggtattggtggcataacaaacgtagaagatgacttaaaaatgttcttaggagcgtaa

SEQ ID NO: 1820 - protein, 549 aa, Thermoanaerobacter tengcongensis
MKMFCYQCQEALKNTGCTTIGVCGKTADVANLQDLLIFTLKGISFLNLKAREVGVNKEKTDRFLIEGLFSTITNVNFDRNFFLRKIKEAVALRDEIKEDLRNKGVRVDEYKNIDAISWTYGTDADIEAISQEVGVLSTEDEDIRSLRELITYGVKGMAAYAYHAYQLGYKDDNIFKFMEKALAKVLDDSLTVDDYVALAMETGKYGVDTMALLDKANTSTYGHPEITKVNIGVRNNPGILVSGHDLKDLEQLLEQTAGTGVDVYTHGEMLPAHYYPAFKKYPHFVGNYGNAWWQQDKEFELFNGPILMTTNCLIPPKDSYKDRVYTTGVVGFEGVKYIPEGPDGKKDFSEIIEHAKRCKPPVEIERGEIIGGFAHNQVLQLADKIVEAVKTGAIKRFFVMAGCDGRMKSRTYYTEFAKALPKDTVILTAGCAKYRYNKLNLGDIDGIPRVLDAGQCNDSYSLAVIAMKLKEIFGLNDINELPISYNIAWYEQKAVIVLLALLYLGVKNIHLGPTLPAFLSPNVTKVLVEKFGIGGITNVEDDLKMFLGA

SEQ ID NO: 1821 - DNA, 1671 bp, Thiobacillus ferrooxidans
  CDS (1)..(1671): transl_table=11
atgatgttttgctatcaatgcgaacaaaccacccgcagccccgccggaataggctgtaccagtgagccgggaacgtgcggcaaggatgaggccactgcggttctgcaggacattctcacgcaccttatgaagggcattgccagtatgcgcgccgggcgggcgatgggtgttgccgacagacgtacggacgacttcattttttatgggcttttcaccacgctcaccaatgtgaacttcactgccacacgttttgtccacctgatccaggaggccagcaaaaggcgtgaacggatcaaattattgtacgaggaagcggcgcgagagcagggcaagactcccgaaatcctgtccggtccggccctcttccaacctgccgatagtctggaacaactgctgcgtcaagcccctagcgtcgccataaacgccgacgtagaacatctcggatccgatgtgatcggtgctcgtgccctcatcctctacggcatgaaaggcgtagcgcttattgctcaacatgcccgcgtcctgggttatcagagcgacgaagtcatgccgcaggcagaggaaatcctggactacttggcaagtaatccaacggacctcgatgaaatgttggaagaatcattggaagtcggccgtttgaacctgaaggtgatggagttgcttgacgttgccaatacggacagttttggagcgcaggaaattacctctgtgcgcatctccccgatccagggcaaggcaatcctggtcagcggtcacgatctccatgatctcaaacaaatcctggagcagaccaaggatcaggggatcaatgtttacacccatggggagatgttgccagccaacgcctatcccttgctcaaggcataccctcatctggccgggaatctagggggagcatggcaagatcagcagcgtgaatttgcagatttccctgggcccattgtcatgacttccaactgtatcattgagccgggcagaagttataaaaatcgaatttttacccttggcccagtggggtggcccggcgtccgccatatcgacaatggggatttcaccccggtgatccaggccgccaaggcattaccgggatttactgccgatgcaaaagagcagcgtatcaccatcggttttgggcatcacactctcctgggtgtggcggataaaatcgtcgatgcggtgaaacacggagatattcgccacttcttcctcgtcggtgggtgcgatggtgtttctccggcgcgcaactacttcacggaggtggcggataatgcccccgccgattcggtagtgatgaccctgggatgcggtaagtatcgattcaacaagcatgaattcggagatattggaggcatcccccgcctgctggatataggccaatgcaatgatgcccactccgccatccgggtagcgggtgccctggccgaggcattcaattgtggggtcaatgacctgccgttgtcgatcatgctctcctggtttgaacaaaaggctaccgccattcacctttccttgctggctctgggcatcaaggggatcaagctggggcccaccctgcctgcctatctcacaccaactttggtgcagaagctccaatcacgtttcgatcttgatctcgatcttattggcgaggcgcaagcggatttgcaggcggctctggcgcatacggcgtag

SEQ ID NO: 1822 - protein, 556 aa, Thiobacillus ferrooxidans
MMFCYQCEQTTRSPAGIGCTSEPGTCGKDEATAVLQDILTHLMKGIASMRAGRAMGVADRRTDDFIFYGLFTTLTNVNFTATRFVHLIQEASKRRERIKLLYEEAAREQGKTPEILSGPALFQPADSLEQLLRQAPSVAINADVEHLGSDVIGARALILYGMKGVALIAQHARVLGYQSDEVMPQAEEILDYLASNPTDLDEMLEESLEVGRLNLKVMELLDVANTDSFGAQEITSVRISPIQGKAILVSGHDLHDLKQILEQTKDQGINVYTHGEMLPANAYPLLKAYPHLAGNLGGAWQDQQREFADFPGPIVMTSNCIIEPGRSYKNRIFTLGPVGWPGVRHIDNGDFTPVIQAAKALPGFTADAKEQRITIGFGHHTLLGVADKIVDAVKHGDIRHFFLVGGCDGVSPARNYFTEVADNAPADSVVMTLGCGKYRFNKHEFGDIGGIPRLLDIGQCNDAHSAIRVAGALAEAFNCGVNDLPLSIMLSWFEQKATAIHLSLLALGIKGIKLGPTLPAYLTPTLVQKLQSRFDLDLDLIGEAQADLQAALAHTA

SEQ ID NO: 1823 - DNA, 1662 bp, Vibrio parahaemolyticus
  CDS (1)..(1662): transl_table=11
atgttctgtattcaatgtgaacagacaattcaaacccctgctgtcaaaggttgttcttttgcacaaggcatgtgtggcaaaacttctgaagtatcagacctacaagacgtgttggtttacacactgcaaggggtttctttttgggcatcaaaagcacttgaattcaacatcattaacgatgaaatcaaccaatgggcacccaaggcatttttctctacattgacaaacgttaacttcgaccctgaacgtatccttgagctaacatctcaagctgcgaattacaaagcactgctcaaagagcaagtaatgtctgctgcgactttgtcaaacaccaaccttgctgacattcctgccgttgccaacttcgagctaccaaacagcgcagaagcgatcttagcttttgctcctcaagtcgcggttaaccgtggtaaagaccaagtacatgaagatgttattggcctacgcctactttgcctatacggacttaaaggtgcagccgcgtacatggagcacgcacgtgttcttgagcaaaccaacaacgatatatatgccgaataccatgaaatcatggcgtggttgggcaccgatcctgaagatctcggcgaactacttgattgctcaatgcgcattggcctgatgaactacaaagtgatggaaatgctcgaccaaggcgaaacaacgaccttcggccatccagaaccaacaacggtgaacgtcaagccagtaaaaggtaaatgtattcttgtttctggccatgatttgcatgacctagaaaaaatcctgcaacagaccgaaggcaaaggcattaacgtttacaccaacggtgaaatgctgcctgcacacggctaccctgagctgaagaaataccctcatctcgtcggtaactacggcagcgcatggcaaaaccaacagaaagaattcgcaaacttccctggcgcaatcgtaatgacgtcaaactgcttgttgaatccaaatgtgggtcaatacgcagaccgtctattcacccgcagtattgttggctggcctggagttgctcacatcgaaggcgatgattttagccaagtgattgaatgtgctctagcgcaagacggtttccaacacgatgaaatcgaacaccacatcacggttggttttagtcgcaatgcactgatgaacgccgcccctgcggttatcgaccaagtgaagcaaggcaacatcaaacacttcttcctagtcggcggttgtgatggtgataaagcggaacgcagctactacaccgattttacggctgaagcgccagaagatacgctcatcctgaccttggcgtgtggtaagttccgcttcaacaagaacacattcggcgatatcaacggcatccctcgcctattggatgtgggccaatgtaacgatgcttactctgcaatccaacttgcacttgcactggcgaaagagtttgactgtgacatcaatgaactgccactcacgcttgtgctttcttggttcgagcaaaaagcgatcgttatcttgctaacgctatttgcattgggcgtgaaaggcatttacacaggccctactgcaccggcattcctaacgccaaacctaatcgccatcatccaagagaagttcgatatgcgcagtattggcaatgttcaggatgatctaaaagccatcctagcagcctaa

SEQ ID NO: 1824 - protein, 553 aa, Vibrio parahaemolyticus
MFCIQCEQTIQTPAVKGCSFAQGMCGKTSEVSDLQDVLVYTLQGVSFWASKALEFNIINDEINQWAPKAFFSTLTNVNFDPERILELTSQAANYKALLKEQVMSAATLSNTNLADIPAVANFELPNSAEAILAFAPQVAVNRGKDQVHEDVIGLRLLCLYGLKGAAAYMEHARVLEQTNNDIYAEYHEIMAWLGTDPEDLGELLDCSMRIGLMNYKVMEMLDQGETTTFGHPEPTTVNVKPVKGKCILVSGHDLHDLEKILQQTEGKGINVYTNGEMLPAHGYPELKKYPHLVGNYGSAWQNQQKEFANFPGAIVMTSNCLLNPNVGQYADRLFTRSIVGWPGVAHIEGDDFSQVIECALAQDGFQHDEIEHHITVGFSRNALMNAAPAVIDQVKQGNIKHFFLVGGCDGDKAERSYYTDFTAEAPEDTLILTLACGKFRFNKNTFGDINGIPRLLDVGQCNDAYSAIQLALALAKEFDCDINELPLTLVLSWFEQKAIVILLTLFALGVKGIYTGPTAPAFLTPNLIAIIQEKFDMRSIGNVQDDLKAILAA

SEQ ID NO: 1825 - DNA, 1662 bp, Vibrio vulnificus
  CDS (1)..(1662): transl_table=11
atgttctgtattcaatgtgaacagacgattcaaaccccagccgtaaaaggctgctcttttgctcaaggtatgtgcggaaaaaccgcagaagtgtccgatttgcaagacgtccttgtctactcattacaaggggtttcctactgggcgactcaagcgcatcgatacggcatcattaacgatgaaatcaatcaatgggcgccaaaagcgtttttctccacactgaccaacgttaacttcgatcctgaacgtattctgcaattaacctctcaagccgctcaatttaaagcacagctaaaagaccaagtactcactgcctcttcattggcaaactcgccactgtcagaggttcctgcggttgccgagtttgaactgccagaaaacgcacaagccattctcgccttcgccccacaagttgcggttaatcgtggcaaagaaggtgttcatgaagacgtcattggcctgcgcttactctgcctgtatggcttaaaaggagccgccgcctatatggaacacgcacgcgtgttggaacaaaccaacaacgacatttatgcggagtaccacgaaatcatggcttggttaggcaccgatcctgaagatcttggcgagctgctggactgttcaatgcgtattggcctaatgaactacaaagtgatggaaatgctcgatcatggcgaaaccgcgaccttcggccacccggttcctaccgcagtcaacgtcaaaccagtcaaaggcaaatgcatcttggtttccggccatgacttacacgatttagaaaaaatcttgcaacaaaccgaaggcaaaggcatcaacgtctacactaacggtgaaatgttaccggcgcacggctatccagaactgaacaaatatccacacctggttggtaactatggcagtgcttggcaaaaccaacaaaaagaatttgcgaacttcccgggggccattgtgatgacgtcaaactgcctgctgaaccccaatgtgggccaatacgcagaccgtttgttcacgcgtagcatcgtaggctggccgggtgtcgctcatattgaagatgacgatttcagtgccgtgattgaatctgcgttggcacaaccgggcttccaacacgatgagatcgagcacatgatcaccgtcggctttggccgtaacgcactgatgaatgccgcccctgcggtgatcgatcaagtgaaacaaggcaacatcaaacatttcttccttgtgggtggatgtgacggtgacaaggccgagcgcagctactacaccgacttcaccgaagccgcaccagaagatacgctgatcttaacgcttgcttgcggtaagttccgtttcaacaaaaacaccttcggtgacatcaacggcatccctcgcctactcgatgttggccagtgtaacgacgcgtattccgcgattcaattggcgttggcgctggcgcaagagtttgactgtggcatcaacgaactgccactaacgcttgtcctctcatggtttgagcaaaaagcgattgttatcctgctcaccttgttcgcactgggtgtgaaaggcatttacaccggtccaacggctcctgcgtttttgacccctaacctgattgccatcattcaagagaagtttgatatgcgcagcatcggtaatgttcaggacgatctgaacaccattcttgccgcttaa

SEQ ID NO: 1826 - protein, 553 aa, Vibrio vulnificus
MFCIQCEQTIQTPAVKGCSFAQGMCGKTAEVSDLQDVLVYSLQGVSYWATQAHRYGIINDEINQWAPKAFFSTLTNVNFDPERILQLTSQAAQFKAQLKDQVLTASSLANSPLSEVPAVAEFELPENAQAILAFAPQVAVNRGKEGVHEDVIGLRLLCLYGLKGAAAYMEHARVLEQTNNDIYAEYHEIMAWLGTDPEDLGELLDCSMRIGLMNYKVMEMLDHGETATFGHPVPTAVNVKPVKGKCILVSGHDLHDLEKILQQTEGKGINVYTNGEMLPAHGYPELNKYPHLVGNYGSAWQNQQKEFANFPGAIVMTSNCLLNPNVGQYADRLFTRSIVGWPGVAHIEDDDFSAVIESALAQPGFQHDEIEHMITVGFGRNALMNAAPAVIDQVKQGNIKHFFLVGGCDGDKAERSYYTDFTEAAPEDTLILTLACGKFRFNKNTFGDINGIPRLLDVGQCNDAYSAIQLALALAQEFDCGINELPLTLVLSWFEQKAIVILLTLFALGVKGIYTGPTAPAFLTPNLIAIIQEKFDMRSIGNVQDDLNTILAA

SEQ ID NO: 1827 - DNA, 1662 bp, Vibrio vulnificus
  CDS (1)..(1662): transl_table=11
atgttctgtattcaatgtgaacagacgattcaaaccccagccgtaaaaggctgctcttttgctcaaggtatgtgcgggaaaaccgcagaagtgtccgatttgcaagacgtccttgtctactcattacaaggggtttcctactgggcgactcaagcacatcgatacggcatcattaacgatgaaatcaatcaatgggcgccaaaagcgtttttctctacactgaccaacgttaacttcgatcctgagcgtattctgcaattaacctctcaagccgctcaatttaaagcacagctaaaagaccaagtactcactgcctcttcattagcaaactcgccactgtcagaggttcctgcggttgccgagtttgaactgccagaaaacgcacaagccattctcgccttcgccccacaagttgcggtcaatcgtggcaaagaaagtgttcatgaagacgtcattggcctgcgcttactctgcctttatggcttaaaaggggccgccgcctatatggaacacgcacgcgtgttggaacaaaccagcaacgacatttatgcggagtaccacgaaatcatggcttggttaggcaccgatcctgaagatcttggcgagctactagactgttcaatgcgtattggcctaatgaactacaaagtgatggaaatgctcgatcatggcgaaaccgcgaccttcggccacccggttcctaccgcggtcaacgtcaaaccagtcaaaggcaaatgcatcttggtttccggccatgacttacacgatttagaaaaaatcttgcaacaaaccgaaggcaaaggcatcaacgtctacactaacggtgaaatgttaccggcacacggctatccagaactgaacaaatatccacacctagttggtaactatggcagtgcttggcaaaaccaacaaaaagaatttgcgaacttcccgggtgccattgtgatgacctcaaactgcctgctgaaccccaacgtgggccaatacgcagaccgtttgtttacgcgtagcatcgtaggctggccgggtgtcgctcatattgaaggtgacgatttcagtgccgtgattgaatctgcgttggcacaaccgggcttccagcacgatgagattgagcacatgatcaccgtcggctttggccgtaacgcactgatgaatgccgcccctgcggtgatcgatcaagtgaagcaaggcaacatcaaacatttcttccttgtgggtggatgtgacggtgacaaggccgagcgcagctactacaccgacttcaccgaagccgcaccagaagatacgctgatcttaacgcttgcttgcggtaagttccgtttcaacaaaaacaccttcggtgacatcaacggcatccctcgcctactcgatgttggccagtgtaacgacgcgtattccgcgattcaattggcgttggcgctggcgcaagagtttgactgtggcatcaacgaactgccactaacgcttgtcctctcatggtttgagcaaaaagcgattgttatcctgctcaccttgttcgcactgggtgtgaaaggcatttacaccggtccaacggcacctgcgtttttgacccctaacctgattgccatcattcaagagaagtttgatatgcgcagcatcggtaatgttcaggacgatctgaacaccattcttgccgcttaa

SEQ ID NO: 1828 - protein, 553 aa, Vibrio vulnificus
MFCIQCEQTIQTPAVKGCSFAQGMCGKTAEVSDLQDVLVYSLQGVSYWATQAHRYGIINDEINQWAPKAFFSTLTNVNFDPERILQLTSQAAQFKAQLKDQVLTASSLANSPLSEVPAVAEFELPENAQAILAFAPQVAVNRGKESVHEDVIGLRLLCLYGLKGAAAYMEHARVLEQTSNDIYAEYHEIMAWLGTDPEDLGELLDCSMRIGLMNYKVMEMLDHGETATFGHPVPTAVNVKPVKGKCILVSGHDLHDLEKILQQTEGKGINVYTNGEMLPAHGYPELNKYPHLVGNYGSAWQNQQKEFANFPGAIVMTSNCLLNPNVGQYADRLFTRSIVGWPGVAHIEGDDFSAVIESALAQPGFQHDEIEHMITVGFGRNALMNAAPAVIDQVKQGNIKHFFLVGGCDGDKAERSYYTDFTEAAPEDTLILTLACGKFRFNKNTFGDINGIPRLLDVGQCNDAYSAIQLALALAQEFDCGINELPLTLVLSWFEQKAIVILLTLFALGVKGIYTGPTAPAFLTPNLIAIIQEKFDMRSIGNVQDDLNTILAA

SEQ ID NO: 1829 - DNA, 1653 bp, Yersinia pestis
  CDS (1)..(1653): transl_table=11
atgttctgtgtgcaatgtgaacaaactatccgaacgccagcaggtaacggctgctcttacgcgcagggaatgtgtggaaaaaccgccgaaacctcagatctacaagacttgctggttgctgtattacaggggctatcggcttgggcgttacaagcccgtgaactgggtattatcgatagccaaattgacagctttgcccccagagcatttttctcaacgctgaccaacgtgaatttcgattccgaccgtattgtggaatacgccaaagacgctattttactgcgccactctctggctgtccgttgccgcctgttggatagcacaattaccgttgatcacccactggctgagttgcaactggtggcagacgatatcccttctctgctgcaacaatcacagcagttcgccctcaataacgataaagcggatgtgggcgatgatattcacggcctgcgtatgctgtgcttatacggcttgaaaggcgcggcggcttatatggaacacgcccatgtattaggccagtctgatgagcaaatttatgcggagtaccatgcctatatggcctggttgggcacccagccccgtgatgtcgataccttactgaataacgccatgggtattggtaaaatgaacttcaatgtgatggccattttagatcagggcgaaacccaggcctatggcgatccacaaccgacgtccgttaatgtccgcccggtagcaggcaaagcgattttaatttccggccatgacctgaaagatttacacatgctgctggagcagacgcagggcacaggcattaatatttacactcacggtgaaatgttgcccgctcacggctatccggagttaaaacgttatccacatttggtggggaactacggcagcggctggcagaatcagcagaccgaattcgccaagttccctgggccgatcctgatgacttccaactgtattattgatccgaatgtgggcaactacggtgaccgcatctggactcgcagcatcgttggctggccaggtgtcaaccacttagacggggataatttcgccccggtgattgagcaagcgctcggaatggcgggcttcccctacagtgaactggaacacctgattactgtcggttttggccgccagacactcctaaatgccgctgataccgttattgatttggttgccagtaaaaagctacgccatgtcttcttggtagggggatgtgatggtagccgtactgagcgcagttatttcaccgatttcgcccgcagtgtgccgcaagattgcatcattatgacgctagcctgtggcaaataccgcttcaataaactggacttcggcactctggaaggattaccgcgcttactggacgtcggccaatgtaatgacgcatacgccgctatcatgttggcggttaaattgtcggaaaaattgggttgcaccgtcaatgacctgcctctcagtttggtgctgtcatggtttgagcaaaaagccattgtcattctgctcacgctattgtcgctgggtgtgaagaatatttacaccggcccaacggcaccaggtttcctgaccgacaacctgatggcgatcctttatgagaaatttggtatgcagccaataaccaccgtagaacaggatatgcaggcgattttgggccattaa

SEQ ID NO: 1830 - protein, 550 aa, Yersinia pestis
MFCVQCEQTIRTPAGNGCSYAQGMCGKTAETSDLQDLLVAVLQGLSAWALQARELGIIDSQIDSFAPRAFFSTLTNVNFDSDRIVEYAKDAILLRHSLAVRCRLLDSTITVDHPLAELQLVADDIPSLLQQSQQFALNNDKADVGDDIHGLRMLCLYGLKGAAAYMEHAHVLGQSDEQIYAEYHAYMAWLGTQPRDVDTLLNNAMGIGKMNFNVMAILDQGETQAYGDPQPTSVNVRPVAGKAILISGHDLKDLHMLLEQTQGTGINIYTHGEMLPAHGYPELKRYPHLVGNYGSGWQNQQTEFAKFPGPILMTSNCIIDPNVGNYGDRIWTRSIVGWPGVNHLDGDNFAPVIEQALGMAGFPYSELEHLITVGFGRQTLLNAADTVIDLVASKKLRHVFLVGGCDGSRTERSYFTDFARSVPQDCIIMTLACGKYRFNKLDFGTLEGLPRLLDVGQCNDAYAAIMLAVKLSEKLGCTVNDLPLSLVLSWFEQKAIVILLTLLSLGVKNIYTGPTAPGFLTDNLMAILYEKFGMQPITTVEQDMQAILGH

SEQ ID NO: 1831 - DNA, 26 bp, Artificial sequence
  primer
atgatcatgttttgtgtgcaatgtga

SEQ ID NO: 1832 - DNA, 23 bp, Artificial sequence
  primer
ttacgcgctcaacagttgcttca

SEQ ID NO: 1833 - protein, 601 aa, Artificial sequence
  consensus sequence
  Variant (4)..(4): Xaa in position 4 is any amino acid
  Variant (7)..(8): Xaa in position 7 to 8 is any amino acid
  Variant (10)..(17): Xaa in position 10 to 17 is any amino acid
  Variant (18)..(22): Xaa in position 18 to 22 is any or no amino acid
  Variant (24)..(24): Xaa in position 24 is any amino acid
  Variant (28)..(33): Xaa in position 28 to 33 is any amino acid
  Variant (37)..(37): Xaa in position 37 is any amino acid
  Variant (39)..(43): Xaa in position 39 to 43 is any amino acid
  Variant (45)..(67): Xaa in position 45 to 67 is any amino acid
  Variant (68)..(74): Xaa in position 68 to 74 is any or no amino acid
  Variant (76)..(76): Xaa in position 76 is any amino acid
  Variant (78)..(78): Xaa in position 78 is any amino acid
  Variant (81)..(81): Xaa in position 81 is any amino acid
  Variant (85)..(129): Xaa in position 85 to 129 is any amino acid
  Variant (130)..(169): Xaa in position 130 to 169 is any or no amino acid
  Variant (171)..(173): Xaa in position 171 to 173 is any amino acid
  Variant (175)..(179): Xaa in position 175 to 179 is any amino acid
  Variant (182)..(182): Xaa in position 182 is any amino acid
  Variant (185)..(185): Xaa in position 185 is any amino acid
  Variant (189)..(190): Xaa in position 189 to 190 is any amino acid
  Variant (193)..(194): Xaa in position 193 to 194 is any amino acid
  Variant (197)..(229): Xaa in position 197 to 229 is any amino acid
  Variant (230)..(231): Xaa in position 230 to 231 is any or no amino acid
  Variant (233)..(238): Xaa in position 233 to 238 is any amino acid
  Variant (240)..(241): Xaa in position 240 to 241 is any amino acid
  Variant (244)..(246): Xaa in position 244 to 246 is any amino acid
  Variant (248)..(250): Xaa in position 248 to 250 is any amino acid
  Variant (252)..(252): Xaa in position 252 is any amino acid
  Variant (254)..(255): Xaa in position 254 to 255 is any amino acid
  Variant (257)..(257): Xaa in position 257 is any amino acid
  Variant (259)..(267): Xaa in position 259 to 267 is any amino acid
  Variant (270)..(270): Xaa in position 270 is any amino acid
  Variant (276)..(276): Xaa in position 276 is any amino acid
  Variant (279)..(281): Xaa in position 279 to 281 is any amino acid
  Variant (283)..(283): Xaa in position 283 is any amino acid
  Variant (286)..(286): Xaa in position 286 is any amino acid
  Variant (288)..(288): Xaa in position 288 is any amino acid
  Variant (290)..(292): Xaa in position 290 to 292 is any amino acid
  Variant (296)..(296): Xaa in position 296 is any amino acid
  Variant (302)..(303): Xaa in position 302 to 303 is any amino acid
  Variant (306)..(307): Xaa in position 306 to 307 is any amino acid
  Variant (310)..(310): Xaa in position 310 is any amino acid
  Variant (312)..(312): Xaa in position 312 is any amino acid
  Variant (314)..(314): Xaa in position 314 is any amino acid
  Variant (315)..(315): Xaa in position 315 is any or no amino acid
  Variant (320)..(321): Xaa in position 320 to 321 is any amino acid
  Variant (323)..(324): Xaa in position 323 to 324 is any amino acid
  Variant (326)..(327): Xaa in position 326 to 327 is any amino acid
  Variant (330)..(331): Xaa in position 330 to 331 is any amino acid
  Variant (333)..(333): Xaa in position 333 is any amino acid
  Variant (335)..(335): Xaa in position 335 is any amino acid
  Variant (337)..(338): Xaa in position 337 to 338 is any amino acid
  Variant (340)..(340): Xaa in position 340 is any amino acid
  Variant (343)..(345): Xaa in position 343 to 345 is any amino acid
  Variant (347)..(349): Xaa in position 347 to 349 is any amino acid
  Variant (350)..(351): Xaa in position 350 to 351 is any or no amino acid
  Variant (353)..(354): Xaa in position 353 to 354 is any amino acid
  Variant (356)..(357): Xaa in position 356 to 357 is any amino acid
  Variant (359)..(361): Xaa in position 359 to 361 is any amino acid
  Variant (364)..(365): Xaa in position 364 to 365 is any amino acid
  Variant (367)..(368): Xaa in position 367 to 368 is any amino acid
  Variant (370)..(373): Xaa in position 370 to 373 is any amino acid
  Variant (374)..(395): Xaa in position 374 to 395 is any or no amino acid
  Variant (398)..(400): Xaa in position 398 to 400 is any amino acid
  Variant (402)..(403): Xaa in position 402 to 403 is any amino acid
  Variant (405)..(420): Xaa in position 405 to 420 is any amino acid
  Variant (421)..(427): Xaa in position 421 to 427 is any or no amino acid
  Variant (430)..(437): Xaa in position 430 to 437 is any amino acid
  Variant (439)..(444): Xaa in position 439 to 444 is any amino acid
  Variant (447)..(447): Xaa in position 447 is any amino acid
  Variant (449)..(449): Xaa in position 449 is any amino acid
  Variant (451)..(452): Xaa in position 451 to 452 is any amino acid
  Variant (454)..(457): Xaa in position 454 to 457 is any amino acid
  Variant (462)..(465): Xaa in position 462 to 465 is any amino acid
  Variant (467)..(467): Xaa in position 467 is any amino acid
  Variant (469)..(469): Xaa in position 469 is any amino acid
  Variant (471)..(476): Xaa in position 471 to 476 is any amino acid
  Variant (478)..(478): Xaa in position 478 is any amino acid
  Variant (480)..(482): Xaa in position 480 to 482 is any amino acid
  Variant (485)..(486): Xaa in position 485 to 486 is any amino acid
  Variant (488)..(488): Xaa in position 488 is any amino acid
  Variant (490)..(497): Xaa in position 490 to 497 is any amino acid
  Variant (501)..(501): Xaa in position 501 is any amino acid
  Variant (503)..(503): Xaa in position 503 is any amino acid
  Variant (507)..(507): Xaa in position 507 is any amino acid
  Variant (510)..(510): Xaa in position 510 is any amino acid
  Variant (516)..(516): Xaa in position 516 is any amino acid
  Variant (519)..(522): Xaa in position 519 to 522 is any amino acid
  Variant (524)..(525): Xaa in position 524 to 525 is any amino acid
  Variant (527)..(529): Xaa in position 527 to 529 is any amino acid
  Variant (531)..(534): Xaa in position 531 to 534 is any amino acid
  Variant (535)..(535): Xaa in position 535 is any or no amino acid
  Variant (537)..(537): Xaa in position 537 is any amino acid
  Variant (540)..(545): Xaa in position 540 to 545 is any amino acid
  Variant (547)..(547): Xaa in position 547 is any amino acid
  Variant (552)..(554): Xaa in position 552 to 554 is any amino acid
  Variant (557)..(557): Xaa in position 557 is any amino acid
  Variant (560)..(560): Xaa in position 560 is any amino acid
  Variant (563)..(563): Xaa in position 563 is any amino acid
  Variant (565)..(565): Xaa in position 565 is any amino acid
  Variant (567)..(568): Xaa in position 567 to 568 is any amino acid
  Variant (571)..(572): Xaa in position 571 to 572 is any amino acid
  Variant (574)..(574): Xaa in position 574 is any amino acid
  Variant (576)..(577): Xaa in position 576 to 577 is any amino acid
  Variant (580)..(583): Xaa in position 580 to 583 is any amino acid
  Variant (585)..(587): Xaa in position 585 to 587 is any amino acid
  Variant (589)..(598): Xaa in position 589 to 598 is any amino acid
  Variant (599)..(600): Xaa in position 599 to 600 is any or no amino acid
MFCXQCXXTXXXXXXXXXXXXXGXCGKXXXXXXLQDXLXXXXXGXXXXXXXXXXXXXXXXXXXXXXXXXXXXXXFXTXTNXNFDXXXXXXXXXXXXXXXXXXXXXXXXXXXXXXXXXXXXXXXXXXXXXXXXXXXXXXXXXXXXXXXXXXXXXXXXXXXXXXXXXXXXXDXXXLXXXXXYGXKGXAAYXXHAXXLGXXXXXXXXXXXXXXXXXXXXXXXXXXXXXXXXXXXGXXXXXXMXXLDXXXTXXXGXPXXTXVXXXXXXXXXILXSGHDLXDLXXXLXQTXGXGXXXYTHXEMLPAXXYPXXKKXYXHXXGNYGXXWXXQXXEFXXFXGXIXXTXNCXXXPXXXXXYXXRXXTXXXVGXXGXXHXXXXXXXXXXXXXXXXXXXXXXXXXXDFXXXIXXAXXXXXXXXXXXXXXXXXXXXXXXGFXXXXXXXXAXXXXXXVKXGXIXXFXXXXGCDGXXXXRXYXTXXXXXXPXDXXXLTXXCXKXXXXXXXXGDIXGXIPRXLDXGQCNDXYSXXXXAXXLXXXFXXXXXNXLPXXXXXXWXEQKAXXXLLXLLXLGXKXIXXGPXXPXFXXPNXXXXLXXXFXXXXXXXXXXXXD

SEQ ID NO: 1834 - protein, 41 aa, Artificial sequence
  protein pattern
  Variant (3)..(3): Xaa in position 3 is Ile or Val
  Variant (8)..(8): Xaa in position 8 is Leu or Met
  Variant (9)..(10): Xaa in position 9 to 10 is any amino acid
  Variant (11)..(11): Xaa in position 11 is Ile, Leu or Met
  Variant (12)..(13): Xaa in position 12 to 13 is any amino acid
  Variant (14)..(14): Xaa in position 14 is Ile or Leu
  Variant (15)..(15): Xaa in position 15 is Leu or Met
  Variant (16)..(16): Xaa in position 16 is any amino acid
  Variant (17)..(17): Xaa in position 17 is Gln or Arg
  Variant (18)..(18): Xaa in position 18 is Ser or Thr
  Variant (19)..(19): Xaa in position 19 is any amino acid
  Variant (20)..(20): Xaa in position 20 is Asp or Gly
  Variant (21)..(21): Xaa in position 21 is any amino acid
  Variant (23)..(23): Xaa in position 23 is Ile or Val
  Variant (24)..(24): Xaa in position 24 is any amino acid
  Variant (25)..(25): Xaa in position 25 is Ile or Val
  Variant (29)..(29): Xaa in position 29 is Cys, Gly or Ser
  Variant (34)..(35): Xaa in position 34 to 35 is any amino acid
  Variant (36)..(36): Xaa in position 36 is any or no amino acid
  Variant (38)..(38): Xaa in position 38 is any or no amino acid
  Variant (40)..(40): Xaa in position 40 is any amino acid
  Variant (41)..(41): Xaa in position 41 is Phe or Leu
ILXSGHDXXXXXXXXXXXXXXGXXXYTHXEMLPXXXYXPXX

SEQ ID NO: 1835 - protein, 45 aa, Artificial sequence
  protein pattern
  Variant (5)..(7): Xaa in position 5 to 7 is any amino acid
  Variant (8)..(8): Xaa in position 8 is Ala, Asp, Glu, Gly, Ser or Thr
  Variant (10)..(10): Xaa in position 10 is any amino acid
  Variant (12)..(12): Xaa in position 12 is Phe or Tyr
  Variant (14)..(14): Xaa in position 14 is Asp or Glu
  Variant (15)..(15): Xaa in position 15 is Phe, Leu or Val
  Variant (16)..(16): Xaa in position 16 is Ala, Thr or Val
  Variant (17)..(19): Xaa in position 17 to 19 is any amino acid
  Variant (21)..(21): Xaa in position 21 is any amino acid
  Variant (23)..(23): Xaa in position 23 is Ala, Cys, Ser or Thr
  Variant (24)..(24): Xaa in position 24 is Ala, Ile, Leu or Val
  Variant (25)..(25): Xaa in position 25 is Ile or Val
  Variant (26)..(26): Xaa in position 26 is Leu or Met
  Variant (28)..(28): Xaa in position 28 is any amino acid
  Variant (29)..(29): Xaa in position 29 is Ala or Gly
  Variant (31)..(31): Xaa in position 31 is Ala, Gly or Asn
  Variant (33)..(33): Xaa in position 33 is Phe or Tyr
  Variant (34)..(34): Xaa in position 34 is Lys or Arg
  Variant (35)..(35): Xaa in position 35 is Phe or Tyr
  Variant (36)..(36): Xaa in position 36 is any amino acid
  Variant (37)..(37): Xaa in position 37 is Asp, Lys or Arg
  Variant (38)..(39): Xaa in position 38 to 39 is any amino acid
  Variant (40)..(40): Xaa in position 40 is Phe or Leu
  Variant (42)..(42): Xaa in position 42 is Asp or Thr
  Variant (43)..(43): Xaa in position 43 is Ile or Leu
  Variant (44)..(44): Xaa in position 44 is Asp, Glu, Gly or Asn
GCDGXXXXRXYXTXXXXXXPXDXXXXTXXCXKXXXXXXXXGXXXG

SEQ ID NO: 1836 - protein, 58 aa, Artificial sequence
  protein pattern
  Variant (3)..(3): Xaa in position 3 is Ile, Leu or Val
  Variant (4)..(4): Xaa in position 4 is Ala, Asn, Ser, Thr or Val
  Variant (5)..(6): Xaa in position 5 to 6 is any amino acid
  Variant (7)..(7): Xaa in position 7 is Ile or Leu
  Variant (8)..(8): Xaa in position 8 is Ala, Gly or Ser
  Variant (10)..(10): Xaa in position 10 is Phe or Tyr
  Variant (15)..(15): Xaa in position 15 is Ala, Ile or Val
  Variant (16)..(16): Xaa in position 16 is any amino acid
  Variant (17)..(17): Xaa in position 17 is Ile or Val
  Variant (20)..(20): Xaa in position 20 is Ala, Ser or Thr
  Variant (23)..(23): Xaa in position 23 is any amino acid
  Variant (26)..(26): Xaa in position 26 is Ile, Leu or Val
  Variant (27)..(28): Xaa in position 27 to 28 is any amino acid
  Variant (30)..(31): Xaa in position 30 to 31 is any amino acid
  Variant (34)..(34): Xaa in position 34 is Asn, Ser or Thr
  Variant (35)..(35): Xaa in position 35 is Ala, Leu or Pro
  Variant (37)..(37): Xaa in position 37 is Ala, Glu or Gly
  Variant (39)..(39): Xaa in position 39 is Phe, Ile, Leu or Val
  Variant (40)..(40): Xaa in position 40 is Ser or Thr
  Variant (41)..(41): Xaa in position 41 is any amino acid
  Variant (42)..(42): Xaa in position 42 is Ala, Asp, Gly, Asn, Pro or Thr
  Variant (43)..(43): Xaa in position 43 is Ile, Leu or Val
  Variant (44)..(46): Xaa in position 44 to 46 is any amino acid
  Variant (48)..(50): Xaa in position 48 to 50 is any amino acid
  Variant (52)..(52): Xaa in position 52 is any amino acid
  Variant (53)..(53): Xaa in position 53 is Ile, Leu or Met
  Variant (54)..(56): Xaa in position 54 to 56 is any amino acid
  Variant (57)..(57): Xaa in position 57 is Ala, Asp, Gly, Ser or Thr
  Variant (58)..(58): Xaa in position 58 is Asp, Glu, Asn, Ser or Thr
LPXXXXXXWXEQKAXXXLLXLLXLGXXXIXXGPXXPXFXXXXXXXXLXXXFXXXXXXX

SEQ ID NO: 1837 - protein, 31 aa, Artificial sequence
  protein pattern
  Variant (2)..(2): Xaa in position 2 is any amino acid
  Variant (5)..(5): Xaa in position 5 is Gly, Asn, Ser or Thr
  Variant (6)..(6): Xaa in position 6 is Ala, Gly or Ser
  Variant (8)..(9): Xaa in position 8 to 9 is any amino acid
  Variant (11)..(12): Xaa in position 11 to 12 is any amino acid
  Variant (13)..(13): Xaa in position 13 is Asp or Glu
  Variant (15)..(15): Xaa in position 15 is Ala, Asp, Glu or Gly
  Variant (16)..(16): Xaa in position 16 is any amino acid
  Variant (18)..(18): Xaa in position 18 is Asn or Pro
  Variant (20)..(20): Xaa in position 20 is Ala or Pro
  Variant (21)..(21): Xaa in position 21 is Ile or Val
  Variant (22)..(22): Xaa in position 22 is Leu or Val
  Variant (23)..(23): Xaa in position 23 is Phe, Ile, Leu or Met
  Variant (25)..(25): Xaa in position 25 is Ser or Thr
  Variant (28)..(29): Xaa in position 28 to 29 is any amino acid
  Variant (30)..(30): Xaa in position 30 is any or no amino acid
GXYGXXWXXQXXXFXXFXGXXXXTXNCXXXP

SEQ ID NO: 1838 - protein, 27 aa, Artificial sequence
  protein pattern
  Variant (3)..(3): Xaa in position 3 is any or no amino acid
  Variant (5)..(5): Xaa in position 5 is any or no amino acid
  Variant (7)..(7): Xaa in position 7 is Ala, Ile or Val
  Variant (13)..(13): Xaa in position 13 is Ala, Cys or Ser
  Variant (16)..(16): Xaa in position 16 is Ala or Leu
  Variant (17)..(17): Xaa in position 17 is Ala, Ile, Leu or Val
  Variant (18)..(18): Xaa in position 18 is any amino acid
  Variant (19)..(19): Xaa in position 19 is Ile or Leu
  Variant (21)..(22): Xaa in position 21 to 22 is any amino acid
  Variant (24)..(26): Xaa in position 24 to 26 is any amino acid
  Variant (27)..(27): Xaa in position 27 is Phe, Leu or Met
PRXLXDXGQCNDXYSXXXXAXXLXXXX

SEQ ID NO: 1839 - protein, 21 aa, Artificial sequence
  protein pattern
  Variant (4)..(7): Xaa in position 4 to 7 is any amino acid
  Variant (8)..(8): Xaa in position 8 is Ala, Asp or Ser
  Variant (9)..(9): Xaa in position 9 is any amino acid
  Variant (13)..(13): Xaa in position 13 is any or no amino acid
  Variant (15)..(20): Xaa in position 15 to 20 is any amino acid
  Variant (21)..(21): Xaa in position 21 is Gly, Ile, Leu or Val
CGKXXXXXXLQDXLXXXXXXX

SEQ ID NO: 1840 - protein, 21 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any or no amino acid
  Variant (7)..(7): Xaa in position 7 is any amino acid
  Variant (8)..(8): Xaa in position 8 is Ala or Gly
  Variant (9)..(9): Xaa in position 9 is Ala, Glu or Asn
  Variant (11)..(11): Xaa in position 11 is Ala, Asp, Glu, Gly, Asn, Gln, Ser or Thr
  Variant (12)..(13): Xaa in position 12 to 13 is any amino acid
  Variant (15)..(15): Xaa in position 15 is any amino acid
  Variant (17)..(17): Xaa in position 17 is any amino acid
  Variant (18)..(18): Xaa in position 18 is Ile, Pro or Val
  Variant (19)..(19): Xaa in position 19 is Ala, Ser or Thr
  Variant (20)..(20): Xaa in position 20 is any amino acid
MXXLXDXXXTXXXGXPXXXXV

SEQ ID NO: 1841 - protein, 16 aa, Artificial sequence
  protein pattern
  Variant (2)..(2): Xaa in position 2 is Ile, Leu, Met or Val
  Variant (3)..(3): Xaa in position 3 is Lys or Arg
  Variant (5)..(5): Xaa in position 5 is any amino acid
  Variant (9)..(10): Xaa in position 9 to 10 is any amino acid
  Variant (13)..(14): Xaa in position 13 to 14 is any amino acid
  Variant (16)..(16): Xaa in position 16 is Asp, Glu, Gly, Asn or Ser
GXXGXAAYXXHAXXLX

SEQ ID NO: 1842 - protein, 40 aa, Artificial sequence
  protein pattern
  Variant (2)..(8): Xaa in position 2 to 8 is any amino acid
  Variant (9)..(12): Xaa in position 9 to 12 is any or no amino acid
  Variant (14)..(14): Xaa in position 14 is any amino acid
  Variant (16)..(16): Xaa in position 16 is Ile, Leu or Val
  Variant (19)..(19): Xaa in position 19 is Ala, Thr or Val
  Variant (20)..(20): Xaa in position 20 is Asp or Asn
  Variant (22)..(25): Xaa in position 22 to 25 is any amino acid
  Variant (26)..(26): Xaa in position 26 is Phe, Ile, Leu or Val
  Variant (27)..(39): Xaa in position 27 to 39 is any amino acid
  Variant (40)..(40): Xaa in position 40 is Ala, Ile, Leu or Val
DXXXXXXXXXXXFXTXTNXXFXXXXXXXXXXXXXXXXXXX

SEQ ID NO: 1843 - protein, 9 aa, Artificial sequence
  protein pattern
  Variant (4)..(4): Xaa in position 4 is any amino acid
  Variant (7)..(7): Xaa in position 7 is any or no amino acid
  Variant (9)..(9): Xaa in position 9 is Glu or Thr
MFCXQCXQX

SEQ ID NO: 1844 - DNA, 3963 bp, Escherichia coli
  CDS (1)..(3963): transl_table=11
atgggaaccaccaccatgggggttaagctggacgacgcgacgcgtgagcgtattaagtctgccgcgacacgtatcgatcgcacaccacactggttaattaagcaggcgattttttcttatctcgaacaactggaaaacagcgatactctgccggagctacctgcgctgctttctggcgcggccaatgagagcgatgaagcaccgactccggcagaggaaccacaccagccattcctcgactttgccgagcaaatattgccccagtcggtttcccgcgccgcgatcaccgcggcctatcgccgcccggaaaccgaagcggtttctatgctgctggaacaagcccgcctgccgcagccagttgctgaacaggcgcacaaactggcgtatcagctggccgataaactgcgtaatcaaaaaaatgccagtggtcgcgcaggtatggtccaggggttattgcaggagttttcgctgtcatcgcaggaaggcgtggcgctgatgtgtctggcggaagcgttgttgcgtattcccgacaaagccacccgcgacgcgttaattcgcgacaaaatcagcaacggtaactggcagtcacacattggtcgtagcccgtcactgtttgttaatgccgccacctgggggctgctgtttactggcaaactggtttccacccataacgaagccagcctctcccgctcgctgaaccgcattatcggtaaaagcggtgaaccgctgatccgcaaaggtgtggatatggcgatgcgcctgatgggtgagcagttcgtcactggcgaaaccatcgcggaagcgttagccaatgcccgcaagctggaagagaaaggtttccgttactcttacgatatgctgggcgaagccgcgctgaccgccgcagatgcacaggcgtatatggtttcctatcagcaggcgattcacgccatcggtaaagcgtctaacggtcgtggcatctatgaagggccgggcatttcaatcaaactgtcggcgctgcatccgcgttatagccgcgcccagtatgaccgggtaatggaagagctttacccgcgtctgaaatcactcaccctgctggcgcgtcagtacgatattggtatcaacattgacgccgaagagtccgatcgcctggagatctccctcgatctgctggaaaaactctgtttcgagccggaactggcaggctggaacggcatcggttttgttattcaggcttatcaaaaacgctgcccgttggtgatcgattacctgattgatctcgccacccgcagccgtcgccgtctgatgattcgcctggtgaaaggcgcgtactgggatagtgaaattaagcgtgcgcagatggacggccttgaaggttatccggtttatacccgcaaggtgtataccgacgtttcttatctcgcctgtgcgaaaaagctgctggcggtgccgaatctaatctacccgcagttcgcgacgcacaacgcccatacgctggcggcgatttatcaactggcggggcagaactactacccgggtcagtacgagttccagtgcctgcatggtatgggcgagccactgtatgagcaggtcaccgggaaagttgccgacggcaaacttaaccgtccgtgtcgtatttatgctccggttggcacacatgaaacgctgttggcgtatctggtgcgtcgcctgctggaaaacggtgctaacacctcgtttgttaaccgtattgccgacacctctttgccactggatgaactggtcgccgatccggtcactgctgtagaaaaactggcgcaacaggaagggcaaactggattaccgcatccgaaaattcccctgccgcgcgatctttacggtcacgggcgcgacaactcggcagggctggatctcgctaacgaacaccgcctggcctcgctctcctctgccctgctcaatagtgcactgcaaaaatggcaggccttgccaatgctggaacaaccggtagcggcaggtgagatgtcgcccgttattaaccctgcggaaccgaaagatattgtgggctatgtgcgtgaagccacgccgcgtgaagtagaacaggcgctggaaagtgcggttaataacgcgccaatctggtttgccacgcctccggctgaacgcgcagcgattttgcaccgcgctgccgtgctgatggaaagccagatgcagcaactgattggtattctggtgcgtgaggccggaaaaaccttcagtaacgccattgccgaagtgcgcgaagcggtcgattttctccactactacgccggacaggtgcgggatgatttcgctaacgaaacccaccgtccattagggcctgtggtgtgtatcagtccgtggaacttcccgctggctattttcaccgggcagatcgccgccgcactggcggcaggtaacagcgtgctggcaaaaccggcagaacaaacgccgctgattgccgcgcaagggatcgccattttgctggaagcgggtgtaccgccaggcgtggtgcaattgctgccaggtcggggtgaaaccgtgggcgcgcaactgacgggtgatgatcgcgtgcgcggggtgatgtttaccggttcaaccgaagtcgctacgttactgcagcgcaatatcgccagccgcctggacgctcagggtcgccctattccgctcatcgctgaaaccggcggcatgaacgcgatgattgtcgattcttcagcactgaccgaacaggtcgtcgtggatgtactggcctcggcgttcgacagtgcgggtcagcgttgttcggcgctgcgcgtgctgtgcctgcaagatgagattgccgaccacacgttgaaaatgctgcgcggcgcaatggccgaatgccggatgggtaatccgggtcgcctgaccaccgatatcggtccagtgattgatagcgaagcgaaagccaatattgagcgccatattcagaccatgcgtagcaaaggccgtccggtgttccaggcggtgcgggaaaacagcgaagatgcccgtgaatggcaaagcggcacctttgtcgccccgacgctgatcgaactggatgactttgccgaattgcaaaaagaggtctttggtccggtgctgcatgtggtgcgttacaaccgtaaccagctaccagagctgatcgagcagattaacgcttccggttatggtctgacgcttggcgtccatacgcgcattgatgaaaccatcgcccaggtcactggctcggcccatgttggtaacctgtatgttaaccgtaatatggtgggcgcagtggttggtgtgcagccgttcggcggcgaagggttgtccggtaccgggccgaaagcaggcggtccgctctatctctaccgtctgctggcgaatcgcccggaaagtgcgctggcagtgacgctcgcgcgtcaggatgcaaagtatccggtcgatgcgcagttgaaagccgcattgactcagccgctaaatgcactgcgggaatgggcagcaaatcgtccagaattgcaggcgttatgtacgcaatatggcgagctggcgcaggcaggaacacaacgattgctgccggggccgacgggtgaacgcaacacctggacgctgctgccgcgtgagcgcgtgttgtgtattgccgatgatgagcaggatgcgctgactcagctcgccgccgtgctggcggtgggcagccaggtactgtggccggatgacgcgctgcatcgtcagttagtgaaggcattgccatcggcagtcagcgaacgtattcaactggcgaaagcggaaaatataaccgctcaaccgtttgatgcggtgatcttccacggtgattcggatcagcttcgcgcattgtgtgaagcagttgccgcgcgggatggcacaattgtttcggtgcagggttttgcccgtggcgaaagcaatatccttctggaacggctgtatatcgagcgttcgctgagtgtgaataccgctgccgctggcggtaacgccagcttaatgactataggttaa

SEQ ID NO: 1845 - protein, 1320 aa, Escherichia coli
MGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEESDRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQALPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVVDVLASAFDSAGQRCSALRVLCLQDEIADHTLKMLRGAMAECRMGNPGRLTTDIGPVIDSEAKANIERHIQTMRSKGRPVFQAVRENSEDAREWQSGTFVAPTLIELDDFAELQKEVFGPVLHVVRYNRNQLPELIEQINASGYGLTLGVHTRIDETIAQVTGSAHVGNLYVNRNMVGAVVGVQPFGGEGLSGTGPKAGGPLYLYRLLANRPESALAVTLARQDAKYPVDAQLKAALTQPLNALREWAANRPELQALCTQYGELAQAGTQRLLPGPTGERNTWTLLPRERVLCIADDEQDALTQLAAVLAVGSQVLWPDDALHRQLVKALPSAVSERIQLAKAENITAQPFDAVIFHGDSDQLRALCEAVAARDGTIVSVQGFARGESNILLERLYIERSLSVNTAAAGGNASLMTIG

SEQ ID NO: 1846 - DNA, 3687 bp, Agrobacterium tumefaciens str. C58
  CDS (1)..(3687): transl_table=11
atggccgatggtgcaagcaatgccggtgtaactatccagcaggtgggaaacagtatcttccagaattttgcgccgccggtgcgcgaacagagcctgctgcgcaaggcggtcactgccgcctaccgccgggcagaagaagaatgcatggcgcctttgatcgaagcggcgacggtgacggctgaccaggcgaaagccattcgcgacaccgcccgcaagctgatcgaggcgctgcgtgccaaaaccaagggcacaggcgtcgaagggctggtgcaggaatattcgctttccagccatgagggcgtggcgctgatgtgccttgccgaagcgctgctgcgcattcctgacaccgccacccgcgacgcgctgatccgcgacaagatcgcgcgtggcgactggaagtcccatattggcggcgggcgttcgcttttcgtcaatgccgccacctggggtctcgtcatcacaggcaagctcacttcgaccgtcaatgacagcggcctttcagcggcgctgacgaagctgatcgcccgcgccggcgaacccgtcatccgccgtggcgtcgacatggcgatgcgtatgatgggcgagcagttcgtgaccggcgaaaccatcggtgaggcgatcaagcggtcgaagccgcttgaggagcagggcttccaatattcctacgacatgctgggcgaagccgcgaccaccgcaaaggatgccgagcgttattacaaggattatgaaaacgccatccacgccattggcaaggcctccgccggccgcggcatctatggcgggccgggcatttccatcaagctttcggcgctgcatccacgctacgcccgcgcgcaggccgagcgggtgatggcggagcttctgccgcgcgtgaaatcgctgatgctgctcagcaagacatacgatatcggcctcaatatcgatgcggaagaagccgaccggctggaactgtcactcgatcttctcgaagaactggcgctggacaaggaccttgctggctggaacggcctcggtttcgtggtgcaggcctatggccgccgctgccccttcgttctcgactacatcatcgacctcgcccgccgttcgggccgccgcatcatggtgcgcctcgtcaagggcgcttattgggatgcggaaatcaagcgcgcgcaggtggaggggctggaagacttcccggtctttacccggaaagtgcataccgatgtctcctacatcgcctgcgcccgcaagctgctcgacgcgcgcgatctggtcttcccgcaatttgcgacccacaatgcgcagtccatggcgaccatctatcacctcgccggtcccgatttcaaactcggcgactacgagttccagtgcctgcacggcatgggcgaaccgctttacagcgaagtcgtcggcaaaaagaaactcgaccgcccctgccgtttctatgcccctgtcggcacgcatgagacgctgctggcctatctcgtgcgccgccttctggagaacggcgcgaactcctccttcgtcaatcgcattgccgatccggccgtgccggtggattccctgctggaagacccggtcgcggtggtgaaggcctatgccgttcccggtgcgcagcacgaccgtatcgccgcccccgccgatctcttcggcccggaacggaaaaactccgccggcgtcgacctctccaatgaaacaacgctctctgccctcgacaaaacactgaaggcgggtgcagcaacggaatggaaggctgcggcgccacaggctggcggccagacgcgcccggtcctcaaccccggcgaccacagcgatatcgtcggccatgtgacggaacccaccgaggccgatgtcgaagcggccatgcagcgggcggcggcttcaagctggccctctatgccagtggaagaccgtgccgcctgcctggagcgcgcggccgacgccatgcaggccgaaatgcccacactgctcggcctcatcatgcgcgaggcgggaaaatccatgcccaacgccattgccgaggtgcgcgaagccatcgatttcctgcgttactacgcggcagaagcccgcaggaatttcaaatcggatgaaaaatcgctcggtcccgtcgtctgcattagcccgtggaacttcccgctcgccatcttcatcggtcaggtggccgcagcgctggtcgccggcaacccggttctggcaaaacccgctgaggagactccgctgatcgccgcgcagggtgtgcgcctgctccatgaggcgggcgttccgcaagacgccgtgcagcttctgccgggcgatggcaagacgggtgcggcgctggtcggctcaccactgacggcgggcgtgatgttcaccggctccactgaggtggcgcggctcattcaggggcagcttgccggccgggttctggccaatggccagccggtgccgctgattgccgagaccggtggtcagaacgccatgatcgtcgattcctccgcgcttgccgaacaggttgtcgccgatgtcatcgcgtctgccttcgacagtgccggacagcgctgctcggcactgcgcatcctctgcctgcaggaagatgtggcggaccgcacgctgaccatgctgaaaggcgcgctgcacgaattgcgcatcggccgcacggatcagctctccgtcgatgtcggccccgtcatcaccgccgaggccaagggcatcatcgaaaagcatattgacggcatgcggtcgctcggtcaccgcatcgagcagattgcgcttgcgggggaaaccggcaagggcaccttcgtaccgccaaccatcatcgagatgaaatcgctcgccgatctgaagcgcgaggtcttcgggccggtgctgcacgtcatccgcttcaagcgcgatcatctcgaccggctgatcgatgagatcaacgccaccggctacggcctgaccttcggcctgcatacgcgtctcgacgatacgatccagcatgtgctctcccgcgttgcggccggcaatctttatgtgaaccgcaacatcatcggcgcggtggtcggtgtgcagccctttggcggacgcggcctttccggcaccggccccaaggccggcggtccgctttatctcggccgcatgacggagaaagcgccaaagatagaccgcatcgccagccagcaggatcaggctgcggtcgatctcgcccgctggctggatgaaaatggtcagactgttgcggcagaagccgcacgccaggcggctgcgctttcaggccttggctttgagaccgagctggccggccccgtcggcgagcgcaatgtctatgcgctgcatccgcgcggcaagatcctgctggtgccggcaaccgaacaggggctttaccgtcagcttgcggcagcgctatctaccggcaactctgttgtcatcgacaatgcttcgggactggaaaaggcgatctacggcctgccggcaagcgtgacctcgcgcatcgtctgggcggatgactgggaaaaatcggcacccttcgccggtgcgctggtcgagggcgatgcggaacgcgtggttgcgatcaacaggaagatcgccgccctgcccggcccgctggttctctttcaggcagcgacgacggacgcactttccggcgaaagccagccctatactctcgactggctggtggaagaggtttcagtcagcgtcaacaccacggccgccggcggcaatgccagcctgatgagcattggctaa

(The sequence listing continues in the following parts.)

The invention claimed is:

1. A method for producing a transgenic plant, plant cell or plant part with increased yield, enhanced nitrogen use efficiency (NUE) or increased biomass production as compared to a corresponding non-transformed wild type plant, plant cell or plant part, comprising transforming a plant, plant cell or plant part with a nucleic acid molecule selected from the group consisting of:
   (a) a nucleic acid molecule comprising the nucleotide sequence of SEQ ID NO: 1055 and encoding the polypeptide of SEQ ID NO: 1056;
   (b) a nucleic acid molecule comprising a nucleotide sequence encoding a polypeptide comprising the amino acid sequence of SEQ ID NO: 1056; and
   (c) a nucleic acid molecule comprising a nucleotide sequence encoding a polypeptide having at least 95% sequence identity to the amino acid sequence of SEQ ID NO: 1056;
   and selecting a plant, plant cell or plant part having increased yield, enhanced nitrogen use efficiency (NUE) or increased biomass production in said selected plant, plant cell or plant part as compared to a corresponding non-transformed wild type plant, plant cell or plant part; and wherein expression of said polypeptide of (a), (b) or (c) results in said increase in yield, enhanced nitrogen use efficiency (NUE) or increased biomass production in said selected plant, plant cell or plant part.

2. The method of claim 1, further comprising obtaining a seed or progeny from the transgenic plant, and wherein said seed or progeny comprises said nucleic acid molecule.

3. The method of claim 1, further comprising regenerating the transgenic plant cell or plant part into a plant.

4. The method of claim 3, further comprising obtaining a seed or progeny from said regenerated plant, wherein said seed or progeny comprises said nucleic acid molecule.

5. The method of claim 1, wherein expression of said polypeptide of (a), (b) or (c) [the nucleic acid molecule] in the plant, plant cell or pant part confers increased yield as compared to a corresponding non-transformed wild type plant, plant cell or plant part under non-stress growth conditions.

6. The method of claim 1, wherein the plant, plant cell or plant part is transformed with a nucleic acid construct or an expression vector comprising said nucleic acid molecule.

7. The method of claim 1, wherein the nucleic acid molecule comprises the nucleotide sequence of SEQ ID NO: 1055 or encodes a polypeptide comprising the amino acid sequence of SEQ ID NO: 1056.

* * * * *